United States Patent 10,407,724 (METHODS AND COMPOSITIONS FOR SCREENING AND TREATING DEVELOPMENTAL DISORDERS) - sequence listing, part 40

SEQ ID NO: 633 - DNA, 4538890 bp, Homo sapiens (residues 1,512,965-3,025,928 of 4,538,890)
  misc_feature (958203)..(1008202): n is a, c, g, or t
  misc_feature (1689175)..(1869174): n is a, c, g, or t
  misc_feature (4240901)..(4290900): n is a, c, g, or t
tcattcttatacaccaataacagacaaacagagagccaaatcatgagtgaactcccattcacaattacttcaaagagaataaaatacctaggaatccaacttacaagggacatgaaggacctcttcaaggagaactacaaaccactgctcaatgaaataaaagaggatacaaagaaacggaagaacattccatgcccatgggtaggaagaatcaatattgtgaaaatggccatactgcccaaggtaatttataggttcaatgccatccccatcaagctaccaatgactttcttcacagaattggaaaaaactactttaaagttcatatggaaccaaaaaagaacccacatcgccaagtcaatcctaagccaaaagaacaaagctggaggcatcacgctacctgacttcaaacattttaatttcaaatacaatatatatctatagatgttatcgatataaataaaagctctttaagggtcctcagtaattttgatgactaaagggatcctgagagcaaaaagtttgagaactgctgctctggtattgtctgttcagagtcctcacctttttctcataacccctactcgtctgtaggaataactcccagatgaagactactctgtaagaagaagcactactatttcctcctggaattctagcctgaaatgtctgaaattctaacaggtggagaaagtgctatgggttaagaattagtccaagcctctgaaataagcacgttctatggcactcagagattaacatgcaagatttgcatttgatttccatttctcaaaataaagtaactaaaactggaaatggagtataagctagattattttctgagccctcgctttgtgtcaggcacttgggagcacagatttcagtaactctgtccttgagtagctcaaagtatagtgggtagacagaaggtgattttatgtgtgtgtcagctcctattgctttcgctgctttacttcggattgtcttaatgttttattttaaatgatatgacaatacttgtatgttcgttaattgtataatgcatctctaatccccttcttcctcttgcattctcccttttctgtgtttgcagtatccggcatatattacttacccagaatgccatgtataggtcaacagatacttttgtggagcaaaaataagaaagaaatagaaaagtttattgtttctctgtgcttgctagcagtgaaatatgtgacatgctttgtattttcatttgtggggtcgtgtgtgtcagcccacctgttgttttatacatttgtttttgccaaatgggttagttgagatggtattaatttatttgaaccaacacatgtcaatgtcactagtaaaacaggatgccagtaagccataccacaaactagcaccatcctgtccacccccaccaagggcccttgccttgatcttagtacaattattgggagtgtgtactcttccttcccttttccttctttctcctccaacctaaatcacctacattgaaattggaaatggcaaactgccttaccagccctttcctcctcttctcttccagactactcctgccacacttacctcctaaaatgatgtttttatcatgttgctcctcaaaaacctcagtgactccattgacttaccaggtccttcatgacctgtctctatccatttgttcatagacaccttccttgtcttctagccaagcacgaatgccaccttcattctcatcttcaagtctttggccattttgtttcttggtcctggaataccctctctcctccctgaagtctctagctagcaatctcccattccattttctgaatgccaattgtaacaatttaacacctagctgctgtgtaattgcatggtgtgaaggttttcttcccaactagatcataaattccttgagagtaatgatgaagtaataaactctttttatctccctaattcccttccctcatagggcaaggtaaagatttattgagtgtcagccatataaatatgttgattacctcttaacccttcctccccaactggaatactcctcagtaagcatttattgaacacctactctgagacaacactggagttgccagaacaatggaagtgagaaggacatggtgtagtcacaagactcaagtagaagagattatgcagtcaacatagatatgtgaacaaagggaatgttgagaggaaagcctatttgagctggccctaggtatgttgaatggggttttaccatactgaaaaaagaatggaggtgggggtgggtgggattccacatagggcagcttgcctgagcacaggcatggaggcctgaaagtacgtggcctaggtagggtataacaaatttgtggcaagagataagtctgttggtgtggatgggatccagatttgatagggcactgaatgccatacaaagaagttttaaacttaactctctacgcatggggaaccagcttataattttaagcaagaaagtgacaaagggcatacaagctttgtaacacaaatatcagccaaacaacaatttcccctgtttgctgtccttcttagctctcaattgcatggcaagtcctatctgtaatcctctagttgggaaaataaatcaaatcccattacatttgttcctggcctaccccaaattctggctgacctcaggcttgtggccatctagaagtttaatttcttccagatgtgccattctctagactgacatgtcgttgtgaagccccagtgtgttatggaaagagcactgggcttggagttcaactatatatggattcaaatctcaactctaaggaacattgaattggtttctcattactctgcagctttaattttttctcttgaacattcttctaaagactgtatcaaaatgggcaatatcacttgcaccatgggtaagtaccactttcacttttactgattatattcataacatctgttttgcttgatttacttgcttcttccaattttcttttgttgaccctttctttctatgcatttactaaaaggacgctttataacccaaacagtgaaccagatagctgctgcaggaaatgtttgaaatgaggcagctcaatttagctggattgttctgtcagtgggttacaggaagaagttcgtaaggtgcctaatgaggaaactaaaaagttttccagcttctcctttgttgggtcttcatcttatagtgtcattattttgttttaatgaattcccagaacaataggtacacccatctgaaactatgactacaggacacattccaaagccagagataagttatttttggactccctgtacctttacttcccatgatttgtttggctaatgtagagttgctggaaccatgtattttaaatcacttcctgagtgaaacataaccagcgaggggagagagagggaaaggaattctgcattactttgcaaattttcttgctttttctttctgtgctagtcaccatatgggactcatggacatttaataaatttacactaaaagaaaacttactgaattgtgctactctcttagcctcagttcttctcatcagctaaaatggttcttgtttttagctaagatttgtagaaaccttgagtgcctgcttgcgaggttgagtgctttttgtaggtttgtcaaatgtaaatctcagagtgagacaaacattaaccataaatattgactctgatgctgcctacatttataaaggaaagatgatttgtcttgtttggattttattatttgtgtttaggttaatattattttcactgttttttcccttgtcctgctattaaggttaaagtagcaataaaagtgtctattggagttcttggtaattcaggactgtagcttgagggagaaatgagagctagaaatagtaagtttccttaataaatcaggttaaatctgggaaatatctgttatctgagttacataggagctaagatccagagcaaagtggaggggctgtttgttttcttttttctttgtatttattttgtttgtttaaagaggacatctgtgcatgtaggtggccttgcttagggagtcagagcccaagtgatatgagaagggcacccactcaggtggttggcttgaatactagaacttaaacacattgaagatgacatctggacttccacatggatatatggcttgctgtgggtgtcagaggctgagcagggtaaagaaggaatctacatggagtagtagttcagttgtgtgagtcaacctgacaggtatgaggagatcatctgtgcagagaagagttgaggaaaagataggagactggttatatacaggaggattgttcaagaaagtaaaaaaattaaaagatttttcattgttaatgaaggggaaggtacatatataggaagagaaaagactaaattgagccttgttatgttggattggaatcagatataagtgaaaacttatgttttttacatgtgtaaatattgatatatgtaaaacatacatgttgtcaatatatataggtggatgtgaaaatatatgtgaaagtgtgtgtgtgttccctacctatgtccattggggagcagcaacccgaataacaatgagcacccagaacatgtcttttaaataccacccccaactaaaaggactcagagttcctggaagaaatggctgatattggagatggagcatgaaaatacaagatgagtctggaatgtcttttgtgacagaaattaagttaattctcaaagcataatggggatatgtcaaaagaacatagaagccagcttgaaaaagttcccactggagaagtttggaaaatttgagtatgaaaacaatagcaatagattataacccattgaaaaaattaggatttatttatatataaattgaatataattttattgaatgaaatgaattcagttgattgaatgaaaatgtttttataagaaatggtttttttacttagtgtcaaagtacctcatcataaaataatcactgttacaaagagacaaatgatatattaacaatgtaaagacctggaagatatcacttttatcaagtgatcaaataagtatcatcattagtggggcaaataaaaagtatgtgccctctaacaggatgcaaatagaagaacacaatgtcacttctctgatattattgtcaaagatgtataacctgagtctatttgtgaggaaacatcaaacaaaccaaaattgagatattgtctacaaaataattagcctgtaatcttcaagagtgtcaagatcatgaacctcataatcccggaacaggatctgttccaagtagcaattacatatgggtattccttccagcacttttcaggaagtttatgtttttccaaattttgattctccccaaaagtcagttgagaaatttggaaagtgggagcaaattagcaatcaacatagaaatgttactggtttgaaggaatctgctgatgttacattcaaagcaagaacagaaaactttgacgcatagagtcaaaggttgaggtcaacatttccaggaagaggtccaggggcttataagagagaaagtcatgatttaattagttaaccttgattatagctgttacatgttgtatgtttatgtccatggtcttgtctgctgctaacagtgagtcattctaccaatgagatcaatagtaggcagggtgctgtggcttacgcttgtaatcccaacactttgggaggctgaggtgggaggattgcttgagcccaggagttcaagaccagcctggccaaaatagtgagaccctatctgtacaaaaaacaaaacaaacaaacaaaaaaacattaactgggcacagtgacgcacgcctgtagtcccagctacttgggacgctgaggtggcaggattgcttgagcctgggaggccaaggctgcaatgagcagtagtggcaccaccacactccagcctgggtgacagagcaagactctgtctcaaaaacaaacaaccaaccaacccacaaaagataaatagtaatacgtttatatgcatagtatactttatatagatcctgagtggtgttccaagaaataacaagcctcagaagtgaaataggcccttatattggcagttttgtcatgtgattctgtgtggtgttgtttaaccttgcttaggagatccaaatgtttaaatattacccaacaatgtttcctgatcttatacatgttgtgtgttgcaatgttcactgtaaggtacagttatttgtaaagcagacaaaatagtttcatcattaaaaaacaaaataaacttctatgagccagcatgtgcccgaaagctcaagtaaagatgctttggatgcactcttaatctgaccaacatcaacacagaatgaattttttttttctttttttttgagatggagtcttgctctgtcacccaggctgcagtgcagtggcacaatctcggctcactgcaacctccgcctcccggtttcaagcgattctcctgcttcagcctcctgagtagctgggattacaggcacacaccaccacgcctggctaatttttgtatttttagtagaggcgaggtttcaccatgttagtcaagctggtctcgaactcctgacctcaggtgatccacccacctcggcctcccaaagtgctgggattacaggtgtgatccaccatgcccggctgattttcttttttcttaaataaaaagtaaaggcacttcttcctgaatgacaggagggaagacagacagagtcaatttctcgtctgttgttggtaataggaaaaacctgctaacaatcctgtattaggcctggttccctagaagcagaagcagagacaggattttgtgtgagtcctttactgagggagtcctctccggagaaagggattgaagaaagcaggataatgaatggcagaaaagtccagcaaggttggattggtgagcagcaagggagcttggctgaggctataaaacatggcttcttagtatcccagcacccatttgatccacacatcaaggttaacttttgtagctgaggaagttgttttatggtcaataattttgtacgttattagtaccttggggtaactttgtatccttccctacctgaccatatatcatcatgtatgcatggtagtgttccagaataacctattatttagttcacatttgcacagatttcaagttacttgtgcatgctaaagaacattgagattgcatttctttttaaattttattttaaattgacatataattgtacatatttatgcggtacagtgtgatgtttcaatacatgtatactttgtgtaatgatcaaatcaaagtaattagcatatccattacctcaaacatttatataggaaatttcccttggggtatctgttctcttagtttcaatcatcaccttgatgttgttaactcccaagtctttgccaatcaatcttcatctcatctggcctatccagcatcatttttgtatctggcccactatgccacaatgattcatgcatagtaggtgttcataaatgtcactcacacttcggtcaagctggtctctttatcacaaatgaggtattgtgaaattgaacacatgatttggaccttaactttaaaaacaacaacaacaacaacactaactgggcaagttagccttttgcagctttcagtttccttatctacactaggagtgataatgccatagcataggaatgtaggaaaaattaaaggaaataattcattttaagcacatagcccagtgcctagaaattgacatgtacctggtaaatgttggttctttctcctttttgctgaatatttaaggcctgctttttaggcctcttacttgatttatcctatttgttttttaccacattcatcactcttagttctgacaacctaggaaaagaagtttctttaaagagttggaaagtttaaaacaaataatatttgtgtaattcagtagaacttttctgggtatgatttttgactaagattttctttaagaaatagggagggtgggcctacataaagttggccataatgcttttaaaaactaaataaatcagtatactaatattttttaagtaaaatttacaatctgaaaaattacacttgggatgaagaacatttttcatctttaatattaaattcttaagaacagcattgaatggcacactatgtttcttttccccatgtcagtcatctagtatttctgtgcatatacactgtattaagacgtctgggagagtcagaagaataagataattttttttccccattctcaaatggccagcacatttctcaatactgatgtctagtttttatttcagttgattacttgtgaactactgttatgtttgtacacatgccctcatttggttttatactcatttgaatggttctcaaatattgccatcaactacatggtaatgctagaggtacattatatctagagggtaactgaatatatttagtttgcatgaatatattcatgcaagagcatgaaagaagacataagactaagtgccaacccaaaaggtgaagattacccagatgtccatcagctgatgaatagataaacaaaatgtggtctatccatacagtgaaataatattcagccataaaaattgatgaagtgctgatacatgctgtaacatggatggatgttgaaaatattacgctaagtgaaagaaaccagacacaaagtgtcacatattgtgtgatttcatttatatgaaatatccagaatcagcaaatctatagagacaaaaagtataatagaggttaccagggcctgggggatggggagttactgtttgttgggtacagaatttctgtttgggatgatgaaatagttctggaaatggatagtcgtgatagttgcacatagtaagtgtactcaatgctactgaattgtatacttcaaaatggttcaaatggcaaatgttacgtgtaagggacttgaagatcattgttataagcctcctatttttctttctgcacaggtgccatggataacagaggctttcagcaggggagttttagtagcttccagaacagctccagtgatgaagacctgatggacattccagcaaccgctatggatttctccatgagagatgatgttcctcccttagaccgagaagtaggaggtatcattattggtgatgataatttatcttaattttttaaaatttatgtacaataaaattttatttttttttaattttattttctagcacacagtcctgtgagtttttaacaaatggctagattattgtaactaccaccactgacaggatacagaacagttcaactccctaaagaattccctcttgccactcctttgcagtcagacctccttcctccctaacccctggtaccagtgatcttttctctgtccttatagtttcttttcttttcaatgatgtcatgtacatggaatcacatagtatgtcactccttgagactgctttcactcagattaatgccttggagatatatctaagttgttcatttcttcttcttgctgagtagtatacccaggagtaggatcacttagtcatatggtaaatgtgtttaactttataagaaactgacaaaccagagtgccggtaccattttgcatctgaactagctatgtatgagagttctacttgctctgcacccttaacagcacttggtattttggccatcctagtataatacgtatgtagtgttatctcatcattgtctcaatttaatttccttaatggctaatgacgttgaatagcatttcatgtgcatatctgcccaccttatatactgtttgatgaagtatatgttgaaatcgtttcctctttctataattggattttttattaactggaatgcattcgtaaaattaaaatccccctccttggttatctggttacctagctgcatattcttttcaatggctgcatacaatttcatggtatgtttgtgccatggcttatttaaccaagcttctattgatgcacatttcagtttttctgatcttttgctgttacaaacaatgctgcaacaaacaaccttgcatctatgtcttctaggcatatgagagtatttttgtcgcataagtgtatgagaatgcctatttccccacaatcttagcagtgctgacattaccattcttttttcatctttacaatatgataggataaataaatctcattttaattttcatttatttaattaatgaggttgagcatatttttatatgtttacaaaccgtttcagtttctttctctgaaagtttcctgttcatgtgatgttcctatttttctaataggctgattatttgtttttatttctttaccagagcccttcatatactattattactcttttgtctgatgtaggttaaatgtattttatccacttctagtttgtctcttttaacttttttttaaatttacagatatttaaaatgtttatatagccatgtatattgcccctttcctttatgacttctgaattccttattgtacttagaaaggacagtatcactttaagattacatttgtataattactttaaaactctgtctggttctttaactgggattgccattgtaaaagtagacagaggacaaggaactgctgtcaaattcattatgcagcaaattcatattaagtacataagacattgtagacactttgctgagctctgggaattagcaaggcttgaagataccatccctgccttcatgaagttgattatagctagctaaatagccacataaatacttatgatagttcctaccccttagagttattttcaggattaaatgagataatacatatatagtgcttataactatacctggcatacagttaagtgctcaataacatgttcagtatcattattttattattattattgctacaaccctgtattataagttctatagcttttataggaatttagcagaataagcatttcatgtgtgggtgtgtttctgcgaaggactggagatttcatagaaaagatgttttggagcgaggtcttgaaagattagttatttggtaggaagaacacttcaggcagaaagtatgcttttacagagatatcaacaggcagaatatatggagatataaaaaggcagaatgtaagtccagatagttggtgttatgtgcatccgtataagagatcacctgagcaggcttagtgtgagcagcaaggctgtttattcacttgggtgcaagtgggctgagtccgagaaaggagtcagtgaagggtggtgggattatcattggttcttataggtttgggataggcggtggagtcaggagcaattttttgcgggcaggggatggatgttacaaagtacattctcaagagcagggaggatgttacaaagtacattcacaaggatggggaatatcacaaagtacattatcacaagggcaggggaatgtcacaatggcttgaccattgtgcggccacctcaaaggatcttacagtcgggccttgaatgtcatgctaataagttttaattaaccttattgtcactgtaaggatgaaactccttcatcaattcattcaacaaatagttttagagcacctgctgtgaaccaggctctattgtaggcactggggatacagtggtgggattaagacaaatattgacctagaacttagagctagctggggagggcagtaaacgagtaaaaagattacttagttaattacccatcatgataagtactaggatggaaataaactgaatgacaatagattataactggggaataatactttagttaggaaggtcagggaaggtttctctgaggaggtgactaatttggggtgaacataccagtataaaagccacaggttaaaaagaataacaaggaatttgccttgggaagatatgtcaggaaagggacagtaggagagggcccctgaatttaaagttcataaaggaagggtactcatggtatagtagttagtggtcatctgcctacttctaccaaagagaactgtgttagcatattgcttctgcttatgtgtagttataaccatactgagtcagttacaccaatcactgactttagtgaagtggtcagttagggggattcataagcttacattggctacctctacttaaagtcttctggttaaaccagagtggttaatcattgttacttctaatagaaaatggtatccatcatctataactgcaaagtactttgtgtgttcatgttgctctcagtagatgattggggcaagtgactatgtattattctcatttcatagactagaaaactgaagcagaatgagattttgacattacctatgattgtagaatgtgttttcacatgaatagtccttcatcacttttcattagcctttacaggagaactactgcttctagtttacaaggtctaaccataaaataatgaggctgcttttcatgagacaaacacgaaaatcagcccacttatagcccactctgtagtgatataactttcttgctttgctttctaattgctcttactttatttaatgttttcacatgggatttcctaataaagacaacgacaacaaaaaggtcacaatgtccttgatattcagaggtgaaactgcataaaatactacattttgtaccaggcacaatagcacgtactaaaaagattagtgagaaggggcttgaaaggcaataaaagtggttcttgttttccagatggctagagggcttgatttatgaggaatgaataaataaattatgcatggcatggttaaatgcatctgaggtagtgttatagtagtttgtaaattagaagaaacataaacatagagatgtgaaagaaggtggagggaatagaaaaagagtttgagtaacagaaaaacacggaggactgttctcatagtccatctgttctcacttgcctgcctctgcagcctgcaccttatggtcagcagtgcattcattcattcattcattcacttactcatttgatacttatggaacacccagatatgagcctagcactgtgctgttttagtaatgctcttcgattccccttttttcctcacctccctgtctttctacctagtgtgccttgctactccctaactgttgaatgaagagacattcctggcagggagagcaacacagataaaggtccagcagcatgagagagccttttatattcaagaaacagagtctgtgggtttgaggtctgaggccccctggggtgggaagggtggtggcagttggagcaagaaggaagactgcaggggctagggtaggaggagatctagttagaaatctaggtggggtccagattgtgtacacttttcgacctcatttgtaaccaaagcaccatcaaatgaactaaaagcagaggaatgatatgatcacatttgagttttagagaatttttggcagtgtggagggtggcttgagtagtgtaggttggagacgagaagaccagtgagtgaaacttgtttttttgtaatctaggcaaaagatcaaaaggcctgaatgaagacagcaggaatgtagaggaagaaataagttctggacaaatttcagagggggaactgataggaccaattagatatgggaaataaaatagaaaagagtcagggatgacttcaaagcctaagcatattattgggtaggctgtgttcccccatactgcctgctgagtttcaacataacctaccaaaatccaggagaagaaaaaaaatcttaatactcaaatgtgatagaataaaaaacctgagggtacttgaaatttgccaagtaaattgcaaaacatttctatttgttttgccacactgtaaaaatatgtcatagtttttctccagagagaaactgaaaacaaagtaaaatatcttgggttccagctcatggagaaatctactattatcacttcagttaggcttccctcaagctatctgactagagcaactgtgtggattgtgtgggaacgaaaagaaaaggtattttgaaattaatcattcttataacacttgaacgtccctaaacacttagcctggaagaatggcaaacattactgttgccttttgaacttaaaaaaaaagtggcccatatggaaagctctgcagggctataaaccacatcaatgtaatatgctggatctttaaaatgaaacctatgatgatgtccacaggctttaaagggttcatttaggttacttaattaggaaaacggccaaattttagaattgatgtcctctaatttttcccccacttactttttttttaattagctaaagtacataatttcttcagatttacttagtttttacctaagtgtctcatccaggatactatattacatattcttcatgtctctaaggagctaagggctcctcttggctgtgacagtttctcagactttccttgtttttgatgaccttaacagttttgaagagtactggtcaggtattttgtagaatgtctctcaattgggatttgtctgatgtttttctcaagattacaatggaattttggagatgaagaccgcagaggtggagtgtctttctcattatgtcttattaaggagcacatactatcaatatgacttatcactgttgatgttgaccttgatcacctggctgaggtgtaatgtttgccaggtttatccactgtaaaactattttttcttctttccatactgtactcttcggaaggaagtcactgcgtagaacagcggtccacaacatttttggcaccagggacagggaccagtttcatggaagacaatttcatcttcaacgaaaccggcggtggggggtgaggatggttttgagatgaaactgttccacctcagatcatcaggcattagttagattctcataaggagtgcacaacctacatccctcgcatgcgcagttcacaaataaggttcgtgctcctctgagaatctaatgccgccactgatctgacaggaggtggagctcaggctgtaatgcttgctcgccctctgctcacctcctgctacgcggactggttcctaacaggccacagactggtatcagtccatggccccgtggatggggaccccctggtttagctcacacgtaggactaggaagttaggtttcacctccatgagggtgaaatatctacagaaattatttggaattgttttacatgggagatttgtctttttctttcccatttatttatctattaaatcatttatatcagtatggactcatttattttgtgctttgagttataatccattactacattttgttggtcaaattgttccagctttggctactgggaactctttcaattgactccatttccctttgacaaactcctatcattgtggggtcttttttgagcatatccttattttttggcactacaacatgctctaggctcatattatatatttcctgccccagtgctagaatcagccatttctccaaggaaccctggttccttttattggaaaatggtattagaagccatgatatggatacatggatactaggtatgctcctttctactgaggcatttgttgcttctaggccctgttagccaatgcagtaaggaaatatgtgtattctgacccatacatatatacacacatatacatatatctatgaatatatgtatatgtaaccacctgtatctacggtaagctaaacatgagatcatactcatgtctctaattctaatctattaccacatggatcactctagcctcctccctttgcttgtctataacctcctactccaacagtgagaaacctggttcctaccactcacaatctgttacttaactgtttacttctggtatgtagtcatatgctacataatgacattttggtcaactacagactgcatatatgataccacgttttaatagtttgtggtataaatagtaccaaatttttactgtacttttctatgtttagacacatacttaccattatgttacagttgactacagtattcagtagaataacatgctgtacaggtttgtagcctaagagcaataggctataccatacagtctaggtgtgtagtaggctagaccatctaggtttatgtaagtacactctatgatgtttgcacgatgatgaaattacctaacaacacatttctcagaatgtatccccatcattaagtaatgcatgactgtacatgtatagtggtttcagaattgttaacccataccctccataagagacaactttatcaagagtgcagcatcattccttttgctttaatcttacaaattttattcattttcacagttacctgggtcagcacttttcacctttatccctttcattgaggctgttttataaatttgtgatgcagttagattcttttttcacatgctgcattctatcctgggatcttcagtctcctaaatgatttttttaatttgcatacattatgttcattctttgtgctgtgaagttctataagttttgacaaatatatagtgtatccactattacagtatcatgtagaatagtttcactgccttaacaagtcccctgtgcattacctattcaatcccttcttctcttgagtccatggcaaccactgacctgtttattgtctccataaatttgcctttaccataatatcatgtaaaaggaatcatacagaatataacctttttagattagcttctttcacttaccaatatgcatttaagattcatccatgtctttgtgtggatttattgctcattccttcttattgctgaatagtattccattgtctgtatatactactgtttgtttatccattcatctactgaaggacatcttggttgcttactgttgggggcaattatgaatgaagttgctacaaacacctgtgtgcaggtttttatgtggatataaattttcaaatcaagtaagtaagtatttaggggtgcgattgttggatcatatggtaacactatgttttgttttgttttgtttcataaaaaaaagtgccaccaaactgtctgccaaagtgccaaagtggctataccattttgcattcctaccagctatgaatgagagttcctgttagtttgcatccttggtattgtcagtgttttggattttagccattctaataggtatgtagtggtatctcattgttttaatttgcatttctctaatgacaaatgatgttgaacatcttttcacgtgctatttgccatatgtacatctttctttggtgaggttcaggttttttgcccatttttaaattgggattttttttattgttgagttttagttctttgtattttggataccagtcctttatcagatatatattttgtaaatgtcttatcctagtctgtggcttgtcttcttggcttttttttttttttttttttgagatggagtctcgctctgttgactaggctggagtgcagtggttccatctcgcttggctcactgcaagctccgcctcctgggttcacgccattctcctgcctcagcctcctgagtagctgggactacaggtgcctgccaccacgcctggctaattttttgtattttagtagagacgaggtttcaccatgttagccaggatggtctccatctcctgacctcgtgatccgcccacctcggcctcccaaagtgcggggattacaggcgtgagccactgcgcctggccgtggcttgtctttttatactctttacagtagtttttgcaaaccagaaatttttaattttagtgaagtctaacttattaattttttttctttcctggatcatgctatttgtattgtatataaaaagtcatcactgaatccaaaatcatgtagattttctcctatgatatcttccagaagttttatagttttgcattttacatttaggtcaatggtacattttgtgtaaatttttataaaaggaggaaagtctttgtttagattatctttttaacatacttatgcctagtcattgcagcactggttgttaaaaacactgtcctttctccactgatttgcctttgcgccttctttaaagattaattgactgtatttgtgtgggtctattttggggctctctattctgttctcttcgtctatgcatcttttcttttgacaataccatgctgtcctgattactatggctttatggtaaatcttgaaatgaggtagtgtgagccttccaactgttcagcttcaacattgtgttggatactctagatgttttgcttttccacagaagctttagaatcagtttattgtagctgcaaaatgacttgcttgggtttctgttgggattgtgttgaatctatagatcaagctgggaagaattgaaatctcaataatactgagttttacatcccatgaacattgactatttattcagatctttagtttctttaatcagtattttgtagttttctgcatatagatcttgtatatattttcttagatttcgacctctaagtatttaatttggagtggggtggggtgactattgtaaatagtattgctttttaaaatttgcaattctagttcattactggtataaggaaagcaattgacttttgtatattgactttatatcctggagtcttactatgttgtctttattagttctaagaggttgggttttttccccttcaggatttttttaggattctttgggattttctacatagacagttatgtcatctgcaaataaagacagttttatttctctctttccaacctgtatactttttattaccttttgttgtcttactttactagctaagatgttgaatagatgaatggtaagagaagacatccttgccttgttcctgctcttaggggaaaagagtctagtttctcactattaactgtgatattagctgtagggccttttttggtagatgttctttattaagttgaggaaattatactttattcctactttgctgagagttaatcatgaatggatattaaattatgaattatgtcaaatgcttttttgttgtcaatggatatcatatgacttttcttctttagcctattgttatgctagattacattgatttttgaaatgttgctccagctttgcatacctggaataaattccacttggttgggattccacttggttggagataactgatattatgcaatgtcgaattcaattttctaatattttaaaaggatttttacatctatgttcatgaaaggtattaatctgtagttttcctttcttgtaatgtctctgtttggttttcatatcgtttaatgttggcctcatagcgtaacttaggaagtgttctctccgctacagttttctggaagagattggggaaaattggtataattttatccttaaatgtttggtagaacttaccagtgaaaccatgggggcctggtgctttctttttggcaaggttattaatttttgattcaataataataatagggaatacatttaagttctgcaggtctattttacaacacgatgatagttaataataaggtattgtatgcctgaaaattgctaagtgaatgtattttaaatgttctcaccacaaaaaataagcatgtgagataatgaatgtatttagtttgatttaataatttacagtgtatacgtatataaaaacgtgtacaccttatttgtcagttgtaccttcatagaggtggaggaaaaatagaagtgggttgtttaagctttgtgtattttgggatttctagctctctttgtttaattaattaatctctagtttaattccagtttggtaagagagcaaactttgtatgatttttaatctttttaaagtgtgttttgtggcccaggatgtggtgtatcttacaaaatatgtgtaaacttgagaagactgtgtattctgctgttgttggatgaagaagttgataaatgtcaattatattcagttaatcagtgaaaaaataataataatagatgtggggctcttcagatttttctgtttctcctgtgtaagttttggtagtttgtgtctttcaagtagttggtccatttcacctgttagtaaatttgtgttcatagtatttctttattatccttttaatgtctgagagaccgggagtcatgacatcttcttcatttctgatatggtaatttgtgtctccgctcttttttttcttggttagcttggatagtagtctatcaattttgttgatccttccaaagaacctgcttttgttgatttttctctattttttcaattttattgatttctgttctaaatttcttattgtctttggtttgctttaggcttatattgttctcttcttctcctagttccctaagatggaagcttaggttattgattttagatcttctttcctaatatatacatttaagcctataaatttccctctaagcactgattttgctgcatccctcaatgttacttctcacatatattatattttcatttatttcaaaatattttaaaatttgtcttgagacattttgacttacaagttatttggaaatatgttgtttaatttccaggtatttgaggattttccagctatttttctgttattggcttctattaatagctcaattccattgtgttaggatttacagcaaactggctaggacttgggctgtatttcatgtttggtgtatctaggtgccagaggcttcaaattcctctagtgtgcttgtttttgtctctcctcttgattgtgagtttccctgaggacaactcctctagagagtctgtgtcttgcagctctttcaactgtgatccactattattatactggagccctgatgaggtggtggtgaagtatgggggaggtggtaattttataatcctctgattaaatgtcactgtttgatggaactgtgttttgtggctgtgaccttcatacatttttctccagtagtatactttttgtcctccctgccctctactctcttctttgactgcagcattcccaatgtgtttacttgaagccctgcaccttgttgagtatgttcccctgctttaggtgagataagaaggctagatgggatgggagtgggaggaatgtccttctcccaactgggataaggctcaggcaaagtattttcccctgaggcctttgttatggagaaatatctggcaagtttcacaatgatttctctttccctccccttgtcagagccaggagggattcttagatcttcactgtgagaacttggtggggttcctggatgtagagctttggtgtgggagctcccctaagaccgtggtccccaagagtttcttgtactcacgccagtccacactcagccttcagcagcttgttcaagttgccatttgtgtttctaccagctccagccatttctactccaggtaagcagatctcagctgtgtctctttgaataagcttctctcttcagattttggggtggcagtttcctctgcaacctcagttctccaatgagtccaagaaagatcattgattttttttggtttatccaaccttttcttgtaagggtgagagcaataacttctaagttctttgcttgcaggagctgaatccagaggttccccattttcatttaataaaaccactttggtcctttcttgaaggaaatatactttcggctccactttgttccaattcatgacacgtggtagaggaagcagttgctgtaatgcttcagggggtatgtgccatatgtttctaagatctggggctaacaggtaatccagagatactgtagccgtatgagtatagctctgtgtagttaaccacatgccagaaatgttgggtctcagtgagatactagattgtcctgtacctcactgatgagcttttctaaggattggtagcaccattttatgatcttgccagtagaacattctcagttagctatgcaatcaaaatatcatttggaattcttcaaagataagggcctctcagaagtcattcaatccaatatatgagtgaccaaacaaaaaatcatcgctaaaatgatacagtatgaatttggaagggaccttaacattatatttactaatacaccttcatgttacagatggaaaacctgtaaacccacagagattaaggcagttgcccaaggtgacacaactagtgagttatggagctaggattggaatccacatcttctcactgcaggataataggtctgatcacactttgttcttatttaaaaactgaataagcgttcttcctctcagggctttccctcttagtgttgaccagaaactatcacctactttgtccacaagtatcccagtaatctgcctcccagaacataagtctgctccttgcaatgtcctgtctctgttcttccagttgcattgctagtattttttcttttcaaaatcacttacataacacataaatatgtctcactataaaagattcaaacaatacacaggtttttaaaatgtgaaagtctcccttgttcttcccactccagagacaaccaccaaaaagaattcagtatgatccttccagttctttctctatccagtcacatatacagacacacatttaaaaaaagacatattctgcttattttgtgacttgcttttttcatataatatgtctgggatacatttctatttcagtacacatcagtctacttctttgcttgcactatttccctattactagatactttcattgtttctgggtttttgctactacaaacagtgctgcaatgaataacacacatacattggtgtgcacaggtgcaactgtgtctttaattcccacatgagatatatatatatagatatatatatatatgcttttttgaaacttatttttctgtccatgacatcacacaattcctatgaatccaaggagaatctcacaattggtattttctgtcttgaaattttccccccactaaagaataattgctagtcttgtgtgcccagtttccttctggaaattaatagaaaccaatgtagacttaggacagaagaactggagaattgctgcttctaaaacaacaattagaagttattaggcaggatcgtgctacccaaaggatttcccaacactgtggtatgtaatatgcattttagggcagtgtctccctacccatcacattccccattctcttgtcagtcccataaatgtgtacaattgagaaggaaggaatgaagaacaagtaagggagtggggcgctgtttactttttgtggggagccctctcagcaactttgtcaaatctagcccctttacttcattgccacattgctttctgtggcatcttagtccagtgggagcctgcagataccaagccaaagtcctcatgctgttttggttactttgataactctgtcagttagcaccctggttccactggtcatgaaagtgagttgagtcaggaacttccagatttgagcagatgctgggaataagaggactacaagagatacaccccaagaaaatagccacaacccagtaaagatggagctgtatccactgggagtaaagagtcagaaggaggtgttagaatctgaattcatgcttgtctccacagctttccctatgcctttctgccatgcccaaccttcctgtttttttctcataactctcaaacttcatttcaatatcatagatttgttggagttcttgcagttccatttcccacatccttcaccaccccttttattgtctagctctcagcagagtcgggatagagtttcttctttgttgtccttcctgcgtgttagacaccttcaagttttaacctgctgtgaacaggaaccaaagcagtggatcactaaatgaaatgagtgcagggatgagattcaaaacaatgcaggcactgcccagtgatattggctgtcagacatagcactggggcagtgtcctggagcctcctggtattccagccgctggatcatgggtaagttcaggagtttctagggtagggtgaggtgggggaggagagtcctgaggaaaaagtggttatttatctgtagctactgaagtatttcagtatttagcaaactggtatggcatacagatgcatatcaacagaatagctgccctgaataagtgtcccaggggtcaaactaagagtacactaaagcataatgtggtcctggatagatactatccaggactctcctggatagatactatccaggactctcctggatagatactatccaggactctcctggatagatactatccaggactctcctggatagatactatccaggactctcctggatagatactatccaggactctcctggatagatactatccaggactctcctggatagatactatccaggactctcctggatagatactatccaggactctcctggatagatactatccaggactctcctggatagatactatccaggactctcctggatagatactatccaggactctcctggatagatactatccaggactctcctggatagatactatccaggactctcctggatagtttcttagatgggagggctactccaactacatttgcttcttggccactggacttaattgagtgggaaaacaaaatagaagcaaaatgaaggcacaagttgctagatagaaagttcctacaaatgttgattaattatcagggcttccgctgtaatgtactatcagacaaataggtgaaatgggatgtgaaagagtttatgtgacttattggcagatctagaatggatgaaccagtacaagaagggaagcaggatgcgggtatggaagtaagaagtggcatataataggctcttagtatttgctgttgaatgcaagtaaagtttaaatgaccacaggatgaatatctgctgatgtgtgttaggcataatgttgaattttttgtacatttggttccagccttgcaaaaatacaatatatcgctgtaaaactgaaatacattttttaaagggactattttcaagtcctgtgatatataccaatagccctgccccatttctttgaatgcttatttatttctttaggttgttgccaattagtgagccctaatgcagctgtgatattactaaagcagtacttcagggtctgtgcatgagatttcttcctattctttttcctcttgtgtttttgttagtgtttaactagttcacttaatcagttactgttcagccccctaggtaaatttctaatggcatattggttagggatttaaataaacattattctcaacagattttttttttcttgtattttaaggggttttccagtttaaagcatcatgtgatttttagaaaaaaaaattagacagtgatttccataatgagaactgagttaaatacattcatttatatgcctcctcattcaagcagtgtgtttctagagacctgttgttaagtctttagatccgagtataaccctaacgggaaagctgtttcaatgttgacttttttctctgactggtttactgtatgtttttcctggactcaggcaatgcaaattagccttttgggggctttttgttctatcattcaagttgagatctaattgtactttaacttgaataatttttgttagaacattaagttattttatatataacattcactatgccttcaaaatttgagataagttttacttttttttttcttatagagacaaaaatctagactcacctaagtaccccaacctgatgtgtaggctcattgtttaatttttctctgccttccttggcagcatatttacatgccagaagcttagctcttaatgcattgtttttttgaaaagccttttgcattttgttactttgtgcatcattagttaatgggtagatcatttctgttgccattcttgacagttaatttttaaaaatttattttctttctattaagttttaaaaatgctaagaaaagaaaccagctagatgtggaatatgaccaatgacttaagctgtttgtcatcaagtcagctatagatatcttgatgaaagtgtgtgaacaagttaaaccttttcactgatgaaacctaaaatagtagcaatggctgtcatcatcatcattgttatacattttaaaatatattgtttttcttattctaaaaatatgatgaatatttttaaattcacagtccacacttgtgtcagttaaccatttagaggtcttcatgtgctaaaagttttcaaaatattgctgtaggggccactggcattgtaaaaattgggaaatgatctggtcagatcagtgtttcagaaagaattctgcttatctcaaaatagtctattattgtgtttttatcataggatgcattaaaagttggtaagaatttctttatcttattttcacaataatatcaattgacctacactgggcagtctgtataatgaacacacactaaagatggtaagtttgccagagaaggaatggagagtagaaaagaataaaagaaataaagcatgtcaaactctgatactggtgcctcatttcttaatctaaattgtcattaaatcttgttttagtatgaggactgaatcatagccaccagccctctagttctcaaaggaagtaactgtacatggaataaaaaaaaaagtcccttccttggaagtgctgataaagcatttgaaaaacacatgaactttcattaaaagtcaataacgtggcaccagctatgcaatccataggaactatatatttttatgtaccaaaaaagatagtatctttgctaaatcgactgctaaatactatagctgctaaagtgtgaaataatcttatagataatgtaaatcatactagataatataagtgaattctttagtggtcttcagatactgttacaggtaaaattgtgtttactaacgaacaacttggaaggaggctttagaggttaggcacattaccctctttgaatgagatagacatacttttctaaaagtttaatggaataagacagtcacggggggaggagccaagatggccgaataggaacagctccggtctacagctcccagcgtgagcgacgcagaagacgggtgatttctgcatttccatctgaggtaccgggttcatctcactagggagtgccagagagtgggcgcaggccagtgggtgcgcgcaccgtgcgcgagctgaagcagggcgaggcattgcctcacctgggaagcgcaaggggtcagggagttccctttccgagtcaaagaaaggggtgacggacgcacctggaaaatcgggtcactcccacccgaatattgcgcttttcagaccggcttaaaaaacggcgcaccacgagactatatcccacacctggctcggagggtcctacgcccacggaatctcgctgattgctagcacagcagtctgagatcaaactgcaaggcggcagcgaggctgggggaggggcgcccgccattgcccaggcttgcttaggtaaacaaagcagcggggaagctcgaactgggtggagcccaccacagctcaaggaggcctgcctgcctctgtaggctccacctttgggggcagggcacagacaaacaaaaagatagcagtaacctctgcagacttaaatgtccctgtctgacagccttgaagagagcagtggttctcccagcacacagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaatggaacaaagctggatggagaatgattttgacgagctgagagaagaaggcttcagacgatcaaattactctgagctacgggaggacattcaaaccaaaggcaaagaagttgaaaactttaaaaaaaatttagaagaatgtataactagaataaccaatacagagaagtgcttaaaggagctgatggagctgaaaaccaaggctcgagaactacgtgaagaatgcagaagcctcgggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagacactcctcgagaagagcaactccaagacacataattgtcagattcaccaaagttgaaatgaaggaaaaaatgttaagggcagccagagagaaaggtcgggttaccctcaaagggaagcccatcagactaacagcagatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgaccgattttgtcaccaccaggcctgccctaaaagagctcctgaaggaagcgctaaacatggaaaggaacaaccggtaccagctgctgcaaaatcatgccaaaatgtaaagaccatcgagactaggaagaaagtgcatcaactaatgagcaaaataacgagctaacatcataatgacaggatcaaattcacacataacaatattaactttaaatgtaaatggactaaattctccaattaaaagacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaactgaactcagctctgcaccaagcggacctaatagacatctacagaacactccaccccaaatcaacagaatatacatttttttcagcaccacaccacacctattccaaaattgaccacatactgggaagtaaagctctcctcagcaaatgtaaaagagcagaaattataacaaactatctctcagaccacagtgcaatcaaactagaactcaggattaagaatctcactcaaagccgctcaactacatggaaactgaacaacctgctcctgaatgactactgggtaaataacgaaatgaaggcagaaataaagatgttctttgaaaccaaagagaacaaagacacaacataccagaatctctgggacgcattcaaagcagtgtgtagagggaaatttatagcactaaatgcgcacaagagaaagcaggaaagatctaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccactgatcccacagaaatacaaactaccatcagagaatactacaaacacctctacgcaaataaactagaaaatctagaacaaatggatgcattcctcgacacatacactctcccaagactaaaccaggaagaagttgagtctctgaatagaccaataacaggagctgaaattgtggcaataatcaatagtttaccaaccaaaaagagtccaggaccagatggattcacagccgaattctcccagaggtacaaggaggaactggtaccattccttctgaaactattccaatcaatagaaaaagagggaatcctccctaactcattttatgaggccagcatcattctgataccaaagccaggcagagacacaaccaaaaaagagaattttagaccaatatccttgatgaacatcgatgcaaaaatcctcaataaaatactggcaaaccgaatccagcagcacatcaaaaagcttatccaccatgatcaagtgggcgtcatccctgggatgcaaggctggttcagtatacgcaaatcaataaatgtaatccagcatataaacagagccaaagacaaaaaccatatgattatctcaatagatgcagaaaaagcctttgacaaaattcaacaacccttcatgctaaaaactctcaataaattaggtattgatgggacgtatgtcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggagataaagggtgttcaattaggaaaagaggaagtcaaattgtccctgtttgcagatgacatgattgtatatctataaaaccccgtcgtctcagcccaaaatctccttaagctgataagcaacttcagcaaagtctcaggatacaaaatcaatgtacaaaaatcacaagcattcctatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgccccaggtaatttacagattcaatgccatccccatcaagctaccaatgactttcttcacagaattggaaaaaactactttcaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcttacctacaactatctgatctttgacaaacctgacaaaaacaagcaatggggaaaggattccctatttaataaatggtgctgggaaaactggctagccatatgtagaaagctgaaactggatcccttccttatgccttatacaaaaattaattcaagatggattaaagatttaaacattagacctaaaaccataaaaaccctagaagaaaacctaggcattaccattcaggacataggcatgggcaaggacttcatgtccaaaacaccaaaagcaatggcaacaaaagccaaaattgacaaatgggatctaattaaactaaagagcttccgcacagcaaaagaaactaccatcagagtgaacaggcaacctacaacatgggagaaaattttcgcaacctactcatctgacaaagggctaatagccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcatgaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagatacatgcacacgtatgttcattgcggcattattcacaatagcaaagacttggaaccaagccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaacaacaaaaaaccaaacaccgcatattctcactcataggtgggaattgaacaatgagatcacatggacacaggaaggggaatatcacactctggggactgtggtggggaggggggagggggaagggatagcattgggagatatacctaatgctagatgatgagttagtgggtgcagcgcaccagcatggcacatgtatacacatgtaactaacctgcacattgtgcacatgtaccctaaaacttaaagtataattaaaaaaaaaaaaaaagaaagaaagagaaattccagagcaaaaaaaaaaaaaagacagtcacagttgggccacaaatggcttttgctttttcagcaatgtagctcatggccacttaatacagtcagttgccacttcattttcaatcctcctccttaatgctagattagttcatcaagtgagtgagataatataacaatgatgaactgaaagcatacaggtcccatgcagtgcctcacatttcataaggttttgttgtattaacatttcagggtgtatcgaaccttaagaattgatgcaagtaatactatttcaaagctctacacatagggtccagttattacagcacactgtgactgggttaatgtttaacagtggctgtcctttgggttcccttagggaatcctcccaatttagggagttgggagatagcaattttatttttctttaccggactgaccttattgcacaattaattaagacctgctttaaaatagccttcacaaccctttaaaaccatggaaacatcatagtgaatttattgtcaggctaaaatagctactttcatccaggttggattaatgagtaccagagttgttgttgctttctgcgtagagcattactactcagaaacaactcattttcttgactatactctgggttttcaaagtgatgaggtgctgttaaagaactgaccttgtatagtaagttcatatgaagtttagtttttcacgttttcctttaattatgatttgtacataagcataaaacatgtgtacagtttaaagaataattattaagtgaacactcaggtaaaccacctcccagatcaagaaaaatgaccagcattccagaagccctgcccttgccatgtgcccctcccacatggcagccctctactctgggtagcttctgtctttacttttgccatttccttgcttctctttgaaatgtaatcacttacatttgtattctaaaatgatataacttgcttgcctgtttttgaacttagaggcatagaatcgtaatgaatgttttgtgcatttttgtgtctggtatctttcactcagcattaggtttgtgagactacccacgttgctgctatctagtgtattttttaaaaaaccttttttatatttgcctttctcccttttatacttaggacccctgtaactctaaattcttttggatatttctactttgccttcttggactttctgctaaatgaagactaagacttgtctggacccaggtttcctgagctgacccgactgcccgcagtttgatggcatttgtttagatgagactacatctttaaggcttctgtgcccggttaaaaatcttcctttctcccaggctggtccaaaggtctggtcacgtgactccaacagtgacatcacattctgaccgccagggaacactggtagttctttaggtggcgtttgttgctgtgaaaggcagagaatgcagcaagtgcccttctaaagcacttcagactggggcttcttttgtaaaagctccccaacctgaatgaccaaatgcgggctgccaaggttatttcttccttgaggcagaaaaaaagaaaactgtgattgaaggtaagcagacttgagcctgaccaaggactgaagcatgccccccgggagcaggggatctggagaattgcaagcagtctgttgtaggattctaatcactgcctgctctttgagaggggcctgacaattgcgtttctaaggaaaccagactacaaaggaggatgatgcggtgctcatgttacctagtgatgtaataggattctttctttcctgctagaagctgttgcagatcttcattttgccttaatatccttaaaggtgggggcctcatttgatatatagtgtatcattagatagctatcagatgatttttaaaatcagtttcacaaaatcctatttttccccttctgaaaggagaactcttaaaccagagcaaattcaactggagcattaacctgccttaaaaagtaaatatctggttgtttggtgtcatgtgttcatgtcagcattggacttgagaattgaaacagcttgccctcccccacctccacacacacatactttatcctctttctgccctcatttcctagctggctttttccctctaagctctcaagaaacacatcagctttcatctttatcagtatgacactgacatgataggaaatgctgggctggtgattcagcagccatccattttacagtcaggtacgaatgaagatatggaaaggactttggttggggtttaagattaacttgttcaccttttccactccacccccaccccgcccccaccctacagatgatttggactctgcagagctttttctttcaaatgtgcaccttgcctgtgaaaggcatgctgacttaggtattcagaagacttacaattggtaaaccaattgtaagtacagcttggggtgttccttcaaactttccccatgacattgctaaagttgtctgtttggagtttacagtgaagatggggatgcagatgggaggagagggagtcagctcaggcccactttggcctcctctgcagagggattcattaccaaacagtctggaggaagccttgtccctgccaaggttggtgctgcaaatgtgagctttggctgggtgaattaaatgatggcattactctgcacttttccccagtgtgcatttgcatagattcctcagtactgttttgtattttgtgtttaatagcaaaatcttattccatcagatgatgttgctgaaatattttgaatcaagtttaagccttgtgtgagtatagcttgtgagtttaaaactttctcccccattcccaccgttcatcaaacaaattttggttcagctgatatatactgattcttggatatgtgctagacactgtagagaagggaacgatgaatcagacatcaggctaccagcaaagagcttgtagtctagaaaggaagataaagcatgcacaaaagtaattgtaatagaagtacccaaagcaaagtagataagggactatgatgggtgggcaggtggatatgtttcttgcagttgaaggatcagggagggacatttcatcactgaatcatacactgttctttaaatctctgcttgtaaatcttagactgtgctgacatacttagagttcctacaagcctgttacatcagagatcaagtcttatacctattgaagggaaatttgtacattccagccaacttaactcgtgaagaggcccacatgctttatttggagtccccagccaggcaaaaaccacttcataggattgaattattgccttataaatgtaaaatggttcttgatgtgatatggctgcaagtgcctttgacccttttgtctcccttccataaactgaaatacctaagctgctccaacctcctttttgtcttttgtttcataaatcctttcccattgcacatcaactcctgtctctctttgtactgtcactctcatctgttgctttccattcacactgcctttagccactcatcattttgtgcctacaccacagaaacctctgaatgtaatggatgttcctaccaggtgactgtatttctttatcaaccccaactgtagtcatctgatagtttaagggcccgccttttggaaccaaaaagaatgtattaaaaatgttaagaatttctgaagtactaatgtctatttcttgttcaatacagaggacaagtcgtacaatggtggaggaataggttcttcaaataggatcatggacttcttggaggagccaatccctggtgtagggacctatgatgatttcaatacaattgattgggtgagagagaagtctcgagaccgggataggcaccgagaggtaagacaaaagatggcacatgggtaagtgttaggaaatacaggggaagaaattgaagatacatattctttctattctttcctttcttcagccctggatgtgactgaatctggtttctgttggcaatatagagtttcatttttaaatttatttttgaagacatcttgcacataatttttttattatactttaagttctagggtacatgtgcacaacgtgcaggtttgttacatatgtatacatgtgccatgttggtgcttgcacataatttttatcctaaatttaaaaaattgtatttagtgatttatcttactatagtaaatagtcgcaaaggatcctcacagctaaaagggatataaatgcctctgaagagaggtgaaaacaaacttggaggaaggtggcaaaataaatgtcaaagatcttcctttcccatataatctctcttttatggttttttccttaatgcaggatattcataactaagaaaagtaaatggttttctgttaaaggaataaaagaaaaaaatctcagagccctagtgtttactgaagcatacaaagtaaactccttgtgattattgatcttgtacaaccataaaaccaaagtaaacttatgctttcaactccaacaaaaccacaagaccagttaaattcaaactggggacattaacttaatgtgataggtaatagatggtacttatggctatggcacaggttcttttgaatttagcaagagaatttccccacttttctctttttgaagtaccgtgaaaacttctcagagagacttgccaaggtcatttgcctttaacttgttgctgtgtatcatttaaattagggaatcacaatttctggtttgtataagggccacgtggagagcttattaaaaaaatagttgtccaaccccagagattctcagtaggtggtcctctggtgagtcacttcttcaacccacaataggtattatttttttttctttcttactatttctgcttggactccagatttgaaatgtgattttttaagctgccccattctctcccaagttcatgatttcctcctcttagaaccaagcaaatctcttgagtagtcaggtggagattgactttcgttcttaagcctttccagctcctgactggttttctcacgaccacctgaacccaggagtcaggttgtcccaagtacaggttttgagaaattccttcttaatccatggatatttggtgattccaccgagttttcttgtcacaactcgaaaagttgatcactataaagcatttcatgttttttcataagatttctgccatttgggaacatatacacatattctttctatcgtatgtatcaattcatcaggcgggctttagaatttctgccatctgtaatttaccagtttgtcatcagttgcatattcaacatgttatccagattatgagagtcacctgtgatatgacaagtgcacacttccttttatattaatggttgcatctgaggcaaattatgccaattagtaatccaaaaccagttaaagtgtgtttatcaaatagcccaagggggctttttgttttatagcattaactgttcattatcagaagggaaacactgtcacagggaaaaatgtaactttgttccttttcagcactgaaattggaaacttagagtcataggtcaaaactatttaaaaaaatgcttttgaaattctcagaataatttattgtctgtgacgttactgtagataaggtggggtaactaagttgccatttcaaagataagaaatagaggtacagagaaaggggaggtaccagtgacaaaactgtcagaatgttgatttttaaaatgtaggccctgaagggttaaattgtcaagtctaggacttaaaagataaaactttctgcacctcctgatagccttgatgttaccagcaggttgttgaaaatgaaaagagatacatcattgctatcacttagtatcggtgaccactgtacaattaggggtttgtgggatgaagtctgggaatttgcctgacctgaaccacagcccccaggtagtaagcctcaatttgtacttttatcactcaaataagcctgtgtttatttattctttgaaaaacattgaaactatttgctgtgagtcaagagattgcccttggaatatctgatgtccaggatagaaagataccactgcaataagcaaaacaagttgatgctataagaaatgatggcttgggaggaagctctgaataaggaacttgtgggcattacaatactgtagatgaaggtggggtttcggtaaacctcaaagttgttagtgaaactggttcagctaaagattatgtgaaaagtagctctaaattggtctctattctccagtgatttgtctttgtatttctttgttgaacagtttttaagtgaaaaaatggtgtgtgtagagtgtaccaatgttttctcattttcccctagattaccaataaaagcaaagagtcaacatgggccttaattcacagtgtgagtgatgctttttccggctggttgttgatgctccttattgggcttttatcaggtatggtaaactgttagttttcaaaacaaatctcctaaaattgtggtatgtctctcccgtaagtcctgagctgagtcacgtactgtgttttcctgtttttctaccttaaatgaattgctggtgaaccttatagaagctcaatgtccccatctgtaaagggtactaatacctgcaattcttaccttgaataaatgaggaaatgcatttaaatgcattttgtacactataaaatactgtatccattttaaggtgatgttagccctttggtgcttgttttgaggaagagcccttctgttggagacagttttttttttaatacatactgcatgggttttaggagataagatgtggaagaggacttcctgagacattttgtgggtgtttcttaaacatctactctctcatttggtgatgcagaaaagcatgtaagatatggctcgtactcccaagaagcttatgatctcattctttcatagtggctgggggtggaatggtgccaccttgccctataaactccatcaaccttccctgccactccatataatatacagtctcactaaaaatggtatacttactgtacaaatacagctttcaaccaagttcccaagaaggtttctcacccggtggggagaggagagggccaaggacactaggtagagatggtaagaggtgtgtccttatggcattaaaggatagggcctaggcaaatctgtaatcttgagctgaaagagaagttaggtggaaacctggaggtggaaggtatacagtggtagttaacagcaagtagaggctctagttttaggctgcctggatttgaatccaagccccaccacttgctagttttgtggctttgagcaagtttcttaacccctggaagccttagtttactgatctgtaaaatggtgataatcaaagtccctatgttagaagtttgctgtgaggattaaatgagatatagcacataatagcacttattaagcacagcagacagttgttaatgctgctgctgctgccgttaccaagagagaataattcatgagccatggagtagaatgtgactgtagcaaatgaagaatggcttatctatagctgggttttaaaaaattgtctagggcagggattggcaaacttctgctgtaaaggagccagatagtaaatattttaggatttgtgggccaagtgttctctctagcacccactccattctgctgatgtggcacgaaagcagccatagacaataggtaaacaagcccagctgtgaccagaaaaactttatttgcaaaaataggagacagacaggatttggtccttgggctatagtttgccaacccatggcctagggtgttaactctgccccttctggctcttacaggagagagaacatggtctggctctttggagctgcctaataatagactgggtggtctgtaatgctaagtattgcagagaggctgaggacaaggaagatggctgagaaaagattatatgacctagcagttaggaacacagcaattaccttgaaaagccatctcagaaaaatattagaagctaaatctattcggtttgtgcaaaagtaattgcattacttttaatggcgaaaaccgcaattgcttttgcaccaacctaatagatttcaagggaaggcaaccactgtagaagttttggtagtcataggagagagaggaagggtaaaggcttgaaatgataacaaggacaagggacagcattttattcttcagggtaggggaaacctaatacaatttgtaaccagagaagaaagaactgactctggggaggaggagaggtagaaggagaagacaggattgagggtaccagtgttaggtgaaataagacatgtacacgtgagacaaccagagaataagccaaactgtataacatcatggtaattttccgaatccaggcagtaacagatagaaggcagagaagattgtggaccggagtggccaagagtaggtgtcaaacaatgtgttagatttgactagattcttcaagtatgtaagtaacctgtgttaacacttttagcacctaccaaaacatacacgacatggcttcccgcccgttggaatgtaggcataatatcctcaactttttaatgtatttcttgtcactaggtggtcagtgaatatttttctttcccttgtacacacagggtattttgtttttaagcattggagagcaacaatagaagcagtgtgtctgaatgctggaacagtctgggaattcaagggctgtgaattttgtgatggctttactatttccctaaagcatgattctgggccatttaatttctttatgccagagtttcttcatctggatgacagaaatgatgagaaggccagaatctaaattactataactgtcttaaccctatcagtctattagccacagtgcatcctaagtccccagttcacgattccatttcccatcattttctttggtgaatgttctgtgtataatactgtttgctctttctcagtaagaaaacttcaggatgttcatgtcctaggttcaggaggcctcaacatgtctatagcttcatctcaccttccatgcacatcacagtttgtgctttgatagattcagctcctttagcctagaatgccttcctgccattgctcaaattcccttgtccatggagcacaatcctgctattaaggcttagcccttctccccataatcttcgtcagctctcctctctaagcaatctcaaataaacatcatagaatattcctcaatgttgggcaattcacatattctgaatcttgtatatatgtatatatgtatatgtatatatatatatgtgagaataaaagaatctttaataaacttgactctttatggatcagtattcataaagttgaagtcaaaatagtgtttttgccctgttagttcagcttaaagacaggcccactagccccttgctcccacttaaccattttgctttccctaagtcccttctatgtagaaattccacagatggcagtgtttagtgcagagataataagtgaaaatcaagcaaacacacaatgagaaagaggttacaggtggaatggggaagtatgtgcttatctgttactttgattcctttcccctcattttctctgacaaagcttattctgatgaccaaagaacagtttccgagattcagtttaactttggcctttccctccctccccacaaatcaggttcgttagctggtttgatagacatctctgctcattggatgacagacttaaaagaaggtatatgcacagggggattctggtttaaccatgaacattgttgctggaactctgagcatgtcacctttgaagagagagacaaatgtccagagtggaatagttggtcccagcttatcatcagcacagatgaggtaacatgtagtgatgttttatgagccattgacttttcttcttacatttattttatttcttatactgtgctcacagcaattgcggaatcttcctttattttcctttccacagaaaggggaaccagtaccagctgcctttctctgtggtttaagtgcagctctatttccatctctgctgatgtgtagagtcatttgacgcttatgtttaaaatggttttttgtttgctttactaagcctggtatttcttcttaggtactagtacatagtgtgactgaatttctctttttctaatcatttcaaaagaagtgtcagaggcagccaacaggtgagctataatttctaatgaaggacagagtgagttaaaaatgtgtttatgtatatggatttgaaaagtgattttccctgagcattgcattagaacattgaaaaaagtacaatgcattccatgtcaaaataacagaaacccaggaataaaattgcctatcatcccattttgtaatcaaatcaatattttcatttgtccttgtcttctagcatacgtttttgttttttttcttgagacagggtctttctctgtcacccaggctggagtacagtgacatgaccatagctcaccactgcagcctcaacctcctagcctcaagcagtcctcccaccagtcctcctcaggagtagctgggactaaaggcgtgcaccaccacacctagataatttatttatttatttattttgtgaaaatggagtcttactatgttgcctaggctggtctcgaactctttgcctcaagtgaccctcctgccttggccttccaaaatgctgagattacaggcatgagccactgtgcttggcctaccatatgttttttgatgccaaggtaactttgcttatttttcagttccttacctttattttaccactcagttatatgtttgatctctcccactgaaaacaaaagcacacaaagcaaaaaactctcaactcccaattccaccctgacttccaccaacaaagacaggtaccatcttagttcactactcatctattttgttagtgagggaaacaagactaggatgtatgtttgtacttttaaacatttatattaccctccttggtctacaaacaatttgaggtggcatgtgcacacacatacacaaatacaaacagtccagggaaaaggaggatagaaaaagaataaagatagaaataggagtgtttatatacatgtatgactatgcatcttggcttaggtaaagggttcaataaaagggatagatacatgccgtatgtttgagagagtttaggtctatgcttctcaaactagggtaaggtcagtgtgccagagggtaggtgaaactataggacaaacattatttgccttcccagagcattactttttcctgaatatttggaattttttttcaaaaattatatgtaaataatcatttaaaaatggaatgcaaaatttcatacttgttaagaaaaaaaaaaatctttcagctctgctcccgggtaccctgtcccatactctgatgcctttgtttactctctcctagattaggagaacttaggtagaaaagtttgagaagtcctacaacttagggtgggtgtgaaagagagagagagagagagagagagagagtgtgtgtgtgtgtgtgtgtgtgtgtgtgtgtgtgtatttcccttgcttttggggggattcttttattttaaatgtaattggccaggcgcggtggcctgtaatcccagcactttgggaggccaaggtgggtggatcacctgaggtcaagagtttgaaagcagcctggccaacatggtgaaaccctgtctctacaaaaaaaaaaaaaaaaaaaaaaaaaaaaaaaaaaaaacatgtatatacacacatatatatataaaattagccaggcatggtggtgagcacctgtaatgccagctactcaggaggctgaggcaggagaatcacttgtacctgggaggcggaggttgcagtgagccgtgatcgcaccactgcactccagcctgggcgacagagcaagactctatctcaaaaaaaaaaaaaaatcctctcctccaaggactgagtgaggtgtgcctcatgcctgtaatcccagcactttgggaggctgaggagggaggatccctcggggccaggagtttgaggccagcctgggcaatatatcaagacccctgtgtctaaaaataaaaaaactgggcgtggtagcaaccacctatagtcccagctactcagaaggtgaggtgggaggattccctgaacccaggagatccaggctgtagtgagcaatgatagtgccactgcactccaacctgggcaatggagtgagatcctgtcacacacacacacacacaaaagtaattacagattcataggaagttgcaaaacaatgtacaaggaggtcctcagtacccttcccccagccttccctccctcaatggcaacagcttgcataaatgtagtaccatagcaaaaccaggaaattgacataggtacaatccacagactttagttcaccatttagtttacacacattgatttatgtatgtatttgtgtgtgtgtatgtgcgcgcacgcatgtagttcatagttcattgccattttgtcctatgtggacatttgtttaaccaccaccacagtcaagatttagaactgttctatcactgcagggctgcctcatgctgcccctttatagctgtatgtgtgtaagcattccaacagttactttcaaactggagcttgagatttgctctagtgacagatttctctggctcttctttttatgaacgaaatccttccctggggaaagagtcctctaggttttggtttttgtttgtttgttttttgagacggagtctcactctgtcacccaggctggagtgcagtggtgcgatctcggctcactgcaagctccgcctcccgggttcacgccattctcctgcctcagcctcccaagtagctgggactacaggcacccgctaccacgcccggctaatttttttgtatttttagtagagacggggtttcaccatgttagccaggatggtcttgatctcctgacctcgtgatccgcccgcctcggcctcctctaggttttaagaagccttctccaaatgccaggaaattgccctcctggtctctgcctctggccagtttgagttacttttcctttcactcccttaccctcttcatttcctacctctgcagtcttcttcctccttagctacattggaaaggcaaagaaatagcaatcatgtgttcctctgagggcctaagataatggaaaacctgtgtcaaatttacaactcagaaaaaacctgagcattctggttctctttgtctaggtcagtgagttactttaatagtgttttgtgttatgaagtcaaaagtccattgggttttgtatttactgagtgagttgcaattcctaatatttctaccagcaagcataacttcctaatcaaaattgctttttttgtaagacatgactatttgcaggccctttaatatggatgaatctttcctgctggtcaaagctagatttcttttgtggcatgcttcatttatcacaggggaatagtctcaaaaagtatattctttctattttaaaaaatagttgtttccattttatttatttatatctggtaccaccagggtccaaaactttctacttatatggttgttcctgagtctgtggtaccaaaattttcttgaagatgtagttatatgtggactctaaaaaagaaagttgagtaaacagaaccagagagcagaatggtggttacctggggcatggaggaggaggaaatggggagaagtggaccaaagggtacaaatttgcagtgaggtagggtgaataagtctagagaggtaatgtacagtagagttaataatgctgtatactaaaaatttgctaagagtatattttagatgctcttaccacacatacaaagaaaggtaactatggaaggtgatatgcatgtaagtttatttcaatgtagtaacaatttcgctatatgtatatatataaaacatcatgttgtacaccttaaatacatacaataaaaaaattttaaaaagcaaagaaaaaagccaaacacccaaaattttgttactataaactatgagaatttgacaccaaggtaagtagccaaaggtgaatttagtggaactttagatccgctcttcacttcagatgtgaagccaaggttcagccattccaaaaaagctgggggggtgctcttaagactcttggtaaaatgacatggaatcatatatatttgactacaaaacccatcaaagcactcatatagaaagagaattttgtttcatggttttccgtttgctcttttccttgttcatccttagaatccatggtaaatttcctttgggtgtagcaaagcatctcattttcagtactaagtggcctgacagtgtttcagtagttgacaattcagaaagaaaagtcttgaacaatttaatctcggtggttttttttttttttggactttttttcctgaaaaaacattactcagaagagctgcatgtctcactgaagctgtctaggctaaaacaagcttctttttccccctgttccagggagcctttgcctacatagtcaattatttcatgtacgtcctctgggctctcctatttgccttccttgccgtatctcttgtcaaggtgtttgcgccttatgcctgtggctctggaatccctgaggtgagtctcttaaaatggtttataaatggttacaatatgaatactttttggttaaaatctcttaatatgtattccagcacataccacaatttgatgaatgttaaacaggatcagatcctgaggccatctaagacctaggtctttccacaagtccctctcagcctgggctaccaggaaattaaagggagttgattcttagcctcctgagggttcctgttgagccaggctctggaaaacttcccctgttccctatccaaaaagcttccagagtatatcccaagattctgacctgaaaaagcagtgttattgtcagctttttcagggcaaaagaaagaaaatcatttggtacctttcccacaatatgatttaggctacatgggatggttaaaaccctgtttctaactacttttggcttagattgcttgacagtgactaaagacactgagacttaggttaccaggatgactttgcccttccctgtttcctgaccaggtaataagtcacaattttttttttttttaagccagggaatcaagactatacctaacctttaaggttgtttcagggacattagccttgtcctctcaaaacatgcctcttgggctaccacgttgtaacatgaggaaaacacctatccctccctctccagctcctccttcatatatgcacactctcatacttacaatacatccttgcccagctatcactcccctccccctaaaaagggggaacatgaaagcttaaagaacagttcttgctttcttgggctcctgggctctcttccaaacagggatcactgtaggtcaagcatttatatgtcacttattcaaaaggtgcagtttctataatgaggtccagatttttgcttcttagccttgttgacttccttagtctatattcaatctttctgtgtttaacctgcagataaaaactatcttgagtggtttcattattaggggctatttgggtaagtggactctggttatcaaaaccatcaccttggtgctggcagtgtcgtctggcttgagcctgggcaaagagggccctctagtgcacgtggcttgctgctgtgggaacatcctgtgccactgcttcaacaaatacaggaagaatgaagccaagcgcagagaggtaataatgaatggccttaatagtctctttttggttgtgagcataaatgatacaatcttagggggtgagaatttgagagttctaccaatgttaatgcaaacaccctttgacccagcaattccacttgtaggaatttatcctacagatatcctagcatgtgtgtgcacaaaggtgtataaggatagtgcagcgtctgtcaacatagtaaaaaactgaagcaacaaaaatgtccatcaatagggaactgatctaataaatactattctgttcatactgtagaatactttgcaaccattaaatgagataaccttttatatattgacttggaattctggctatgaaacaccatttgattttaaaagccagtttctgagtaatgtatataatataattcatattttttaaaagtgtacatgcacttattgatagaaaatgtctggaaggtggttttaccccaaactggttttacttttttttttttttgagacagggtctcactctgtcacctagactgcagtgcagtggcatgatcacggctcactgcagcctcgacctccctggctcagatgatcctcccacctcagcctcccaagtagctgaaactacaggcacgcaccaccaaacccagctaatttttgtattttttgtagagacggggtttcactatgttgcccaggctagtctcgaactcctgcgctcaagcaatcctcctccctcagtctcccaaagtgctgggattacaggcatgagacacgatgcctggctcacgtcaaactgttaaaaatgtttatctatggtgagtgggagagtgaggggtagtgaaggagaagtaaggattttaactttttattgtatgtaattctattcaagtatatattgcttctcttacaaaataagttacagaaagaatagattttaaaagaagttgtttattgctatggaatagtacatataagtgcagtgtatgtttcagatgtcggttttttcactttctatttctatctaacactatacttgaattagtttctctctgtattggacctctctctaccttttgtttcagcccagctaaattagtcccgccatggcacctctgtagtggctgtcatgtttatgcagttgttaatgtatgctgttttgaggaggaaggacttttttaaaaaaaagttccaagtcattggtttacttttttcttgctataattaagggcctaagagaataatggctcttgctttattttctttgaattacaaagaagtcacatatggaatgggtcaagactaaggtcatttcacttaaaaggatttttcacaaaacaggaacctaatgatttcttatgaaaaccaaaaaaaaaaaaaaaattaaccacaagacccagaaggaaactcaaagatattgagatttcaaatatagaataaattttgttggttcaagggagaaaggtcctggcactgttagaaaggagaggaaagctagcaggagagaagatggggaaatatgagtagattgtttaactacctgtcatgcagtagagggacttaaaggtagtgttaagttggtgaggttgttaaatgggaatgacattcaacagaagggaagagttgagaaaacattttttttctagaagggctttattagaacagttatgaaatttgaatgagatttatagatcaaataacagttattagtgtaaatttcctattttgatcattgaactgtgattatggaagagactgtctttgcttttaggacataaaagcatttatatcctacatgcactgaagcatttcagggtacatgagccttatatgtgcaactgacttttctgagtgaaattccaattcttcagaaaaaaatagaatcataaaacaaatgcagtaatggtagcaattacagaagctacatgaagatatgtaggacttctttgtgctattctttcaccttttctgtgtttgaaatttttttaaaaaaatattataatggttaagagtgaagtggtgattgttgctggttttgcatggatgaaggtgaatttgaaactacagattgctggggactttcattctaaaaattggcatttttgttcaaatagtttctaataaaataagaggggaattcgatttggctgtttctctctacagatgccatatatttctccagttagactcatatgaatacagtcatgtctcaatgacagggatatgttatgaaaaatgcattgttaggagatttcgtcactgtgcaagcattatagattgaagttacacaaacttagatggtctagcctactacacacctaggctttatgatatagcctatggctcctaggctacaaacatgtacagcatgcgactatactgaatactgtgagcaattgtaacacaatggtaaatatttgtgcatctaaacatagaaaaagcacagtaaaaatataatataattttatggggccaccatgttgtatgtggtccatcattgactgaaacgttgttacgtggtgcgtgacagtatttgaattggttttttttgtttttgtttttgttttttttttggagacagggtctcagtcttttggccaggctagaatgcagtagtgtgatctcagttcactgcaacctccatcacctgggcttgagcaattctcccacctcagactccccagtagctaagactacaggcacatgccattatacccagctgattttgtgaatttttttgtagagactgggttttgccatgttgcccaggccagtgttgaattcctgggctcaagtgatcctcctgcctcagcctcccaaagtgctgggattacaggcatgagccaccacaaccggctagtatttgaatcttaaatttactttctagcacttatttagactttccagttattttttcctgttgctttcatcatcagcggcaaccttttttgtcttatggccttgtcaaagtgggcagatggttgagagtaaaacagacttgagaaagaagggtgtagacagactccactctacaatataaaattaaagcaaactagctaccccgattctttctgtctcttgattcatcctaaacatagtcactgaaatcccctttctcaagttgcatgttggctgtcctcatctttcttaaatgaaagccattgtagctaggaatttcaaagcccttccagctagcaccagagattccattctttcctccccatcattttcctgagccatcctactcttccagataatcctatatgcttattttgccaaggacctttttattcttcaaaactcgtaattttgttcaactttctctaaaatatttctttacttcttcaaatcatctctctccatagcaaccagaatccaatgaaaggacttggtccatctattaattttggtttgtttgccattattagtgtttgtcatgtacattttacatgtacacacacacctacacagaggtggaggtctctaagtatcactattctttctctctttatcactttttccctttggctccttcttcctctcccactctctcctagtccctttccttgccatatcttaagtcttcccttaaaaatctagtcacctccctatttctgtgtccataggttattgggcatggagtaggacacagggtacgagagactctaaatacctattgcatgaatacttgcagctgctgaataactgtgaaccaattgtgacttcagttttatgtcattagagccttcttgaacatctcatttaaaaagcattcctttgcaaagttccatataaataaatacatcactgtaagtacatcatttagatggtgaacaaataggcctagaaattcaaatgcagttactgaattgggagtatgggagataagggcgggggggcggtgcataatttagaataaaacacatggctaaatgaattacaaaggaaaggtcctcttacctggtcaagcatgtgaactatgcatgtgtattcaaaattcagcatacagtgtttgaattttgtttttgatgatatggaacatctagaggtatttttaaatgttcagtaactactaacatttcttctaaaaatgtgattgagtgattgaggaaagcagcattattctgtcactaattctgagttttggattttaggtcttgtcggctgcagcagcagctggtgtatctgtagcctttggagcacctataggtggagtattattcagccttgaagaggtaacaacttttcattgtacagcatgtgcatgcttttgtgtcaggaattttgtacattgcagcgcaataattttgtacataatgtacaatatctgtgtatatcccagtccctgagtgctctccccaacttggtgctttaccatgtgactagaaatccagtcggcagttttcatccattagttgactctcatgcctgcagcacaacatttcacctgaaatagtttctgcgtattgactgagtttgctttctcaccttctttcttctaggtcagctactattttcccctcaaaacattgtggcgttcattctttgctgccttggtggcagcattcactctacgctccatcaatccatttgggaacagccgcctggtactattttatgtggagtttcacaccccatggcatctctttgagctcgtgccattcattctgctgggcatatttggtggtctgtggggagcactgtttatccgcacaaacattgcctggtgtcggaagcgaaagaccacccagttgggcaagtatcctgttatagaggtactcgtcgtgacagccatcactgccatcctggctttccccaatgaatacactcggatgagcacaagtgagctcatttctgagctgtttaatgactgtggccttctggactcctccaagctctgtgattatgagaaccgtttcaacacaagcaaagggggtgaactgcctgacagaccggctggcgtgggagtctacagtgcaatgtggcagctggctttaacactcatactgaaaattgtcattactatattcacctttggcatgaaggtgaggaattcttttgggactcagtggctgcatgcgtagctgtgggttttggagggcagagcccaggtatcatacaatcctgatagctcatatggtgctttcaaatccccctcacattattcccccacccccaaagcctcttttaccccacacgttctcataatttgctagacacttgtacctctatctcaaattgtccaagccttgagttgtccaaatgccagcctcagtgatgaaattttaggaagaatgtttgctccttttctgtggaaaacatattttgcccctcaaaaatgatggtgaagtatttattccagtacatttcatattaaaatgatatctgaccaccacagtgttactccttatagggtggctttagagtttaccaataaagcacaatattgattgaaccaaagaagttgctgggattcgaccattttgactgctaaaatggcaatttcctgtggttcaacccaatatatagctaaatatagttttttacagtggtatcaatgttcagttgtcaagaagtgggatccacttcacaggtgatccttagttaatatttaagctatcaaaagtggacatcaggctggcacgttttactttaggtacctgttaccatttccacgtttcagaagaagccagaaaagaaaatttgttaaggtattttcctcctcctttctaggtttttgtttgtttctttcttttctttagcaccctaactaccaagttattttcctctattctctagagaaatggagattcaagccagaagagatagcaactcagtttaggcattattgtaatctctaagatgacgccatccatcccctcaatacagggaagggatggagaccctgagaaattttgcagtgcttcttgagttaattttcacctcatgcctgcattctttcacttaaagggaatttgtaaaccatcagaacaccagattcaaatgcattccaaaatcaaacacaggctattttaaaagaatctgctgttttggttatccttatcatcatttccctctctcagtacagaatattaagaatttactatagtatcctaggagtcaagaaaaagagtggggagatagatgagctttacttttttggttaatcttgtaaccatagtcatgatctcattacaattttttaattgtttaatctttcttgatactgttacaaaatagactgaaacctcatgtgctatatcctttttgtgtgagcaatgggctaagattcaatatatgagcatggttatgagcattccatttaaatcccagcaccagtctttactaaatcttgaccttgggtgggttacttaacctctctgaaccttaggttctttggcatttgggaataataatgcctgcctcctggggttataaagaacccatgaatcttgcatgtagagcgtccagcatagaacatggtaggtactcaataaagggtagtcattgttgataagaattcaaaattggtggaaatgtctgcatatatgagaaactccatctattttcctttttctttgggaaaggcccaatttctgcctccagttctgtgttggtctggagagttcaggctcttgcctgatggaccccgaatcagggtaagcttctttgcagtcgtccttgcctgcacgtcccagagaacctctagtccctgtagtgttacacacacctttacagccacttgctagcatagtgcatagttaaattgtcatcggcctgtttgctttgcagagggtcagtcctccagcccttaccatgtgccaagcaatcacatcatttctcactaaccatctattggtttctctttgcagatcccttctggcctctttatccctagcatggctgttggtgctatagcaggtcgacttctaggagtaggaatggaacagctggcttattaccaccaggaatggaccgtcttcaatagctggtgtagtcagggagctgattgcatcacccccggcctttatgcaatggttggggctgcagcctgcttaggtgagtagtgtttgcattaatttcaagttgctacccaggtgacatacaacagaagagtttattaaacacagttgactgtaggagaatttaaatgcccatccctttccagttaggtttgccattttccaagcacattaagaaagcatctggtatacagatgaggaaactaaaaaaaataaaaataaaaatcataataaaaaagaaaaggaattctactctcatactggggaaataatcagaaatttagacaaagatatctgcacaagaatatgtatcatagtataagagcaaaaaattagaatcaacctaaatttgcacttgagggactggttaaatgaattatggtacatccatatgatgttatacaatgcagcctttaaatgtgatgttaattgttaatatgtttaacatcttaaaatatgatgttatataaatttgtaataatatgcagaatgttcccaacataaagtagagggggaaacatggcagaaaattaaacatataatgtgagttcactcatttaaaaacatatgtttttgcatagaaaaaaacttgaaaaagtcattcagaatttttactctgcttatttattggcagtcagctaatagataatgactttcttttatattttctggattttccacaatggcatgtattttctaattagggaaaagaagcaacagaaaaatgaaagaacaaagaaacaagaaggcatcttggactggacatggtagctcacacctgtaatcctagctacttaggaggcagaggtgggaggatcacttgaggttaggagtttgagaccagcctgggcaacatagtgaaaccccaattcgacaaaaaataaaaagttagttaggtgtggtggcacatgcctgtagtctcagctactcaggaggttgaggtgggaggatcacttaagcctggaagatggcagttgcagttagtagtgataatgccagtgcactctagcctgggtgacagagcacaaaacccgtctcaaaaaaagaaagagagagaaaaaagaaaaacagaaggcttcttgtagatgttattttgagaactctgaatcgtctccattgtgaccttgctttcttgcaatctctggggtctgcacagttgtaggtgagacctcattgtttttggtaggtcagcttttcctggaaaggcccataattgtaagaatcctgtattttgcctacctgagtagactgtgtctatttctttgcaggtggggtgactcggatgactgtttctcttgttgtcataatgtttgaactgactggtggcttagaatacatcgtgcctctgatggctgcagccatgacaagcaagtgggtggcagatgctcttgggcgggagggcatctatgatgcccacatccgtctcaatggatacccctttcttgaagccaaagaagagtttgctcataagaccctggcaatggatgtgatgaaaccccggagaaatgatcctttgttgactgtccttactcaggacagtatgactgtggaagatgtagagaccataatcagtgaaaccacttacagtggcttcccagtggtggtatcccgggagtcccaaagacttgtgggctttgtcctccgaagagatctcattatttcaattggtaaggatttcagaaaggggatagtggaatccactgtggaactcaataaatatgcctgaaatgggggaagacagggaaggggggactggttaggagccagaaggatagagctagcacgtccatcttcaatttgttttttccttctgtttgaatagaaaatgctcgaaagaaacaggatggggttgttagcacttccatcatttatttcacggagcattctcctccattgccaccatacactccacccactctaaagcttcggaacatcctcgatctcagccccttcactgtgactgaccttacacccatggagatcgtagtggatattttccgaaagctgggactgcggcagtgcctggttacacacaacgggtaagaagtcttgagtgaagtcaaattgaattgtgggagaaagagaatgcagagatagaaagaagtagaaagaagtagaacccagtttaaatgaacattagtagcacttttaggacttcttgaagctctgagatgaaagtggataggtttttttaaatcataattaatgtaaagggagtttgggaaagaacatgtgtttgagagatgtgaactgctggttgcatattataaataacccagttcctccctgacaaaggaaacacctgtgttttgtgcataggcagcactgaaattacagtagcatcaggtaatagtgtatttgctgggtgtttgttccctacaatctccttattattacttgaggatgagaaaaccaagtttcagtgaggtgagatttatacaaagttctccagctaataaatagtagagaaaggctttaaacacaagtcttctgactcccaagcccatggctctttccttcctgggatagttcttatccagtaaagggaacccttctatttttattggaaaagaaaggaggttgaggagaggggtggatttttttcccaaacatgctacgttaatccagcaattatataagaatttcacatctgaaatttctaaatggtgtaacagatgccttgcaggatttaaatcagtaaggggagttccctaactggttcattcaacatctgctgaatccctgctccatgtaagaaggtactccactggattccagggagacacaaaaattaataagacccttctgtgccctcaaggagcagacagtgttttaaggaaggcaagaacctagcagtggttatagtacaatagcaaagaggacaagtgccactgaggaggcctgcaaagaatgtgcatgctgttgctgtgaggagggcagagttcctgctggctcatagaatcagggaaggtgctctggaataggggcgtttgaactgggctgcagtagataagattcagatatgtagcgaagagtatttaaaccagaggaaatcgcagggtctgagacctagaggtagaaacacttgcatacatttaggaatccacacatcatcctatttgcctggggcacatgtcctactcctgtgatctcatactgaaagggcagctagtgatcaaagacaaagttgaaaaggactgaggaggacaagtatcacctttgggaatgctattttaactacagatttatttttgtttttttgtattgtgtttgtcttttaggcgattgcttggaatcattaccaaaaaggatgtgttaaagcatatagcacagatggcgaaccaagatcctgattccattctcttcaactagaatcatagagttctggatgtaaagcgggaaggacattacagaccatggatatgttgtattaactgggtacccaaaacacattttccatatttggatggtgaagtcacattagtgtgttgtctctttcctacaagttaaccagttgcactacataatctctggaaattaattttctctttaggagaaattatagttaggcttccatgatgttacattaggaagatatcatgaaagaataaataagattgctatggtttaattatatttgctttttaaaagatttttttaacttaaaaagtagttagccaatatgcaatcactgaaaactatgcaagagaaattccaaccgtcctgacctataacctgtaggaaaccgacgaaaaagtcactcttttgggatctaactgttgttactggaagacgaagtgtaaactaaggggctttgcttttcaaaccagagaaaggaaagccagaaggaaaagagtaatggtattttctagactgtgaagattcagttcaaatgttatccttgttcctgttacaatatttagcattattagtttgttatgtgtgtatgtttatgttaattttaatttctgattataagacaatgctgctttggttaatctcttctaaatgaatttagagagattgacttttatagcttgcttgttgctggtactcttttgaagtgcacaaagataagttatagagctttctccttgtctgcaaaaacggtaattttccaggtggcatttgttagctggtagacaaggactttgccgtgaatttgttagtagcaaggaatgatttcttccagcttccttgaaatgaataattagtaaacttctaagcaaagtcaatgactaggagtttcacatgtttgtgaggtcctaactaattctcttacccagatgccacctccatgaatgatggtgctttaggcttctggaatatgtaaaaacagcaaagggaaccaagtctagactgcatactggtaaaccagggaagactcagaactgcatatgcatcctcatgcattcctttgtaaagaccaccagtactaaaataactggacactcattgtacctcccagcgataagtatgtgtaacaggccagtgtgttgtccccatgatcatgaattaggcttgggatgcttccaaatatattcaaggtgttggaacaggataggcagctgtgactccctcaagagtccttagaattctaaataaaatgcagagccatcctaagacacaggggtatggacaaggcctggtgacaccaaaggtgcttgtatccaattgaaaaggtgcctgtctcaatttcataccacctttattgcagttaaaaaaaaatcacactctggggacacttggtggaattacagagccaccatcatcattccaaccactatttcattttctgtagttttacctgtgtgcaattactccccctccattctgttccacttcttactccttagtaccaaatcctctgtttgggattgagcgctgctcctggttaatcattcctactacaaaaaaaaataactcccagggctagttaaattgtaaaccaaggctcagcagtctcacaacacatggaccagaggtgacacacagccatttcctttgccatgtggcccagttgctgctgccatgcctccatttccacactggatgcctacggcagtgagatttcactgccggggtaagagttcagcctggatgattttatagctctgttcctagcacttctcatcatccttccagcccagaatcagcggtcattctgcatattcccaccaaccctctacccccaaacacttcagtgtacctcattttaagagttgctgatccctgattctaggacgtttttacccatagttcttgtctttccaaaatctgaaattcttttttttgctcagaactgggtagccaagggttattttatttttatctttaaaataatcaaggcagtcgctagagtttctccttgtgaatagatcactctagcattttaatgaaaaagaaaaaaatctttctggggtatgttgtatcatagtaatggctcagtaaccacatattttgtcctttccatgtcactgattccttcatatgagactatttggcttgactaccctgtatattgtgtagaaatcaaagttcttatctgtacatttctggtccaatacctgtcttattagttgtccttccccactaaagtttgcaaaacagaaaatgttactatttctggtatttaatgacaatgaaaggtttggtcatatttcatagtgcagtagcgataaggagggtgtctcaagtttgcttttgtgtttcttctaggctttgttcttgattttagacagatgagccagtgttaaggtgctacttcagagaataaattagagaaatcagataacactgtgccaaggtatactttgtagatgctaagcaccgattggccctccagagaatgacaatatccctttgatacctcactcctgatcaatctcattcattaacctcagcttctcaggaatccttgtagcttgtatgctagaagtagctatggtatatggtatccactatatgtccagtcctatggtttggctcaaaggttggctaattgcagctagagctctcaactgctagctcagcaccttgacatttgaagtttcttgtcttgaggagaaggaaaatgttctttctgccattgccactttaacagttggacatgcttaagcaacaaatacagccagtatagggaggactgtcagtagcatcaaatggccacatacctcaatggcaaaagactagatggtttgtgatttaaaaattaatgagtcgagatgagactattttggtattaaatgagaaaattgcctaacacaagggaagggtttacaaaagaatgccaattagtgtttcaacagagttaggattttccaagtaagagtagctggtagccatccagccataaaaggaacgagagtctatagatttgtaaaagtaaaactgctatattttgtatcttcaaatcttcaatataaagaatttaaagaacctgaaacagttaatgcatgattcgttatattggagggaaaaagcaggggactgataatacaaaataatggcaactttaaagatcatttctacgtggatgtttggttagaaacatattccaatgctctcctctttctctggccacagcatcctggctcagcccagctgtggagtagaggtggtaagatccacagaacagatatcctctggtagataagctgacattgatgatactttgaatttaccagctggtgaagcaaacgattaatttgtgattgaactgaaaagcagttgaattgttttgacaccagaggctgaatctaaaccctttacaggaagagcagagcatactatacatttcttagcagatcttcaattctgtttgaacatgatgaagtaaccagggtttagtgagatctaaggccgtgaagtaattcacaaccaagatcttatgaacgcattcagatgtgaggggggcaaatatgttttcaaaaacttagtgtgcaatagagtccattatagaaattaaccactgctatatgttttaagtagttcaatcacctgttgtggttcagtcttgattattgtttattttgttaggtgataagtaggaagatgcacttgttatcccacactatctcttgttttgttttgttttgtttttaaataatgaacagtgcaatctttgaacttgagtttttaataatgatagcaaagacaatggtgagaacttgaaacagccagcatattttatattgccaaagtacttactgatgactgaccacactgtcttgtgaggaactgggtcccctgcactggatcagagccaaatgcaagccacccatcagttcagaggaagcaggaaaacatcttttgggtggtgcatagaacattgagctcttaaaaacccggagaaaaattaggaatttagaaagtaagtgggaggtagaatattgagtccttttttaaaaaaaagaattgatgtctaaatatgtagtctgaacttaagtgtcctaaaaccttgttttttgtttttttgttttttgaggagtcgtcttgctctatcaccaggtgggagtgcagtggcacaatctcggctcactgtaacctctgcctcctgcctcccgggtccaagcaattcccctgcctcagtctcccaagtaggtgggactacaggcgcacaccaccatgcccagctaacttttgtatttttagtagagacggggtttcaccatgttggccaggatggtctcgatctcttgacctcgtgatccacccatctcggcctcccaaagtgctgggattataggtgtgagccaccgcacccagccaaaccttgatttttttagccacctctgggattgcctgggttccctttggagaagaaactaaaagttatggccatagaaaaagccctggtaagaaaatatttgaatggtgtaagatggtggaaggaaagccatcccacacccctacaacatatgttctggcatttataaactgcttgattgtgtgcctcaaggggagaaaaagtcaagcaatgcttcaaaggccaggctttctaagcaaatgagtggttcaaagcagtgtttggctcaagggcagtctggttttatggatagggccgacccaagacatctgctcatgaagaaatgtggcatctgttgccatttcctaaactataaggtttagatagattgtcttgaattttgatagcaaatttttttaaatttatatttctgcctcctcgtacatccttatatatggaaaaaaaagtaagagttcctcagatcagagctcagtagctgtgtcaatttgaagttcaatcagtgtagttgtcctggggtgatcgctgactctgctctgtttcatatttcagttgcttgctccaaggagagaatttctgagaacaatgggtgttagcaactttaagttactccccaaacgtttgctggccacattctcatttctaaacatctggatctgggtaaaggtttgaatagatgtagggaacaaaattggtttttccatggtgtagtctaattttgccaaatcacccaagaaagaaagtatatgacgtgtggagtttgcatttcttggatgggacctatcgggtcacccagcccagtcttacagtcataaattcctacctcttagttcctgccaaagggccttcagcctctgtgtgcacacttattgaatgaatgctttgcctaaagtttggccttttgaagaaaaacagcatgtgataatataaaaatatgagagtttaaaaaaaaaaaagatctctgcctctcttctctctgcctcgtcccaccttgctgtctgtctcattgtctttctctcccctcaccatgcgctgaattcagatttctctttcttttattataggcatgttgttttgaatgtggactttgtgggagggagaggattgttctgagaacagaaactggaagatacgtctgagttgatgggaccaacagggctttgctcctctgtgagggccaaagccattgatacttgtcgggggtgatgagggctttagcatctcaaggcagacatatgaagtatttactgctaaactatattacttactagtacaaatctgttggaattcaggggcagtctaagatttggtgagtgaaatgccatctggcaaaatcgagaagagagtgtggcctgagaggggaatgttcagcctcactgtcacattaagggtacctcaaaatacatggtccttccagtgtgttccttttccttcctccatttcactttgtcccctcttcttcctttctctcccattttcctggctttttagcactcagcttttttttataagtatgtatttactttttattatatatttggtcctttgggactttgtgatgattaagaatttattccattcaggattttaaaatgatgtgtttaatattttgttctcttaaactcttttgaagctatgctgctaaccaggtataggccagaaaggaggtggcccagtcagtaccttgctcacgtcagctaagggggacagtgatgtcatgtgggtgactcttcttcatttgaccaaggccagcctcctgttcttacctctgcccattcatttctggctatgggaaaactaccacctgttgagtgagccaatgaggccaggaagatcagaggggctgggttccggcccatgggccactatttgaatttctctgtagtaagctctttgtagggctggctccaactgcagtagccaaagaaaacctgtctgactcgacattttaatgcctgagagttggtgaaagttcagctgaagctaatgtctagacatcagcagtaactaggcatccagaaagtagcttcaaccaaagctaatagagcccaagtttccgcaggaagtttggtgctgagctgtccagagcagttgtttatctgagtgttgctagcccttagccatgctttcttagctttattctcgcctgttcctaggcatagcctgaaccagagctatggctcactgctcgctttattctactccctagtcatgcggaacaacatagtctaaaaaggaagatgtggactggggagttaggagacctgatttctattccctatgcttctactaactagcctcgagatcttaaccgctctgtgcctcagtgttcccatctgcaaaatggggatagtgttaattgccctacctacctcacagggttgttgtgaggataaactgagacaatgaattcaaagcaagttgacaagtaagtgctatgcaaattgtaagaaatggaaacaatcatgttaaaagcaatggaatggacattggcagaagggttaatggattgtccagccctttctctgtgtggcttaaacccaggtcgccattgctttatacattttcacttagcacagatttgtaattatgcatgtaataaagcacagccttatccaccctggtgtctggtgtgtttctaaagaccctaaacttggtagctattgatttctgatcagaaaaccacaggggcagagtggaaggttcaggggagggtagcacaaaacacaactgcaaacccctactggcaggcccactgcttaaaaagatttattaaatagttattttcacatttacagactcagtaatactctttaccataaggaggcaaataagaggcagcttgcgtttttggagatgttccagatacccggatacctcattcattgtggctacttaaatgttcctgtctcatacattggtgatactttcctgatgatgtgagaattggctgggagctgtatttttctctctctttgagctcttaatgatgtaaggtcgtgggctttgacaggcctcttgcctacagctactttgtacaaggaggaggatgggtaatcaaaacggtcctcccatgaatactaggattcttagtaccctctttatggtgtattgggattaaaatgtcttctgtacgaaatcctctgaagttaccctgtagattaaagtggggtgaggtatggggaggttgctgtatctgtggacattttcatgccttgctggaacacggaaagctacactttgaagtacagctttcctactttctcactctatttttcctgtgtctcactcccccactcactcctgctctctgttagccaggcagtactaggaagacagtgtaccatgtgtccaagttttactttaagaatttccctagttgacatttgatcacacctgcactggtgttgacttgatttcttgttgctactgagaactttaatgcctttggcctagttggtgtcatttcaggaaggacacctctgtgtgaaaatgactccctcataagcctaaaatcccacaaaatttcagttattgatgttatttatcattttaccgtaccccttccacactaccgtcattcctgcctctaatctctataccttttaagaaatagcattacatctgttaccagctatcaacaacttgctgtgaatcagagtgtcatgtctagtcactgtagagctcagataaaaggtgctttgatggagtatgaagtacagacctatccatcatctcttacaggagcagcccagagaaaaagctggaaataaccaccagatgtcagtgcaatcattaaaatactgatgtggctgaggtctggccggaggggaactgtgaggggtaggcagggcaggaagcattaattcatatatgtagctcggtgctgggaatgcaaaattcaatcatatgagtatttcttcctttatcagacattctcttaatgtatataatacactttatgcttttcttattgtttttaaagaaatcaaccacaaggcagtccctgcctgtaaggagcttactgtcctggtatctgaaagttgtagtttctttttctaagcaatgtcccaggtgaaaacattgaggaaagaagggctctaattcctccctcagtaggggtggccatatcatttgctgtatgactggggcacttttgacagtgggagggacaacaggcataaactaggactctcccagggcaaccaagaagtgcggtggttctgttcctcagggatcttcagctcctgtcctttggagtctagctccaggcctcccaagctcttttcctagcatctcaggctctgccctccccttgagctcccaaggcccctcccctggactctctttcctccctcataataagccctctcaactgccactgggttgtgggataagagaaatgctcaaacaacctcaagtaaaaaattcatatatcaaaaacaaaaatagagctctgagaagagagcaacgttcagggtaagaggttcactggggcctcctcaagctgccaggttgaggattttctatacctatatgttgcccactgctagtgtctctaaatcgaccatttgagcatcttcattccagaggttgcagatagaagagaaggtagagaagagggaataagcataggatttgatgccagaggacctggactcaaggtttactaccttgaggaattggctacctttcttttattatttttttgaagacagagtctcactgtgttgcccaggttgatctataaagtcctgggctcaagcgatcctcccacctcagcctcccaaagtgctgggattacaggcatgaaccactgtgaccagctaccttccttgatgaaacaaaactcaggatctctatgtttggccttggatgaacagcctcctcttgaaaaggggcttctgcatctcacagtatggctttgtgttccacaagattctccttgccttggaggcagttttcctagttacctcactggcctaggggtgtggtggagatcatcccctttttaatattctggctcaagtgtgcctccagagcccagctgagctgaaagtagaacttttcatctaaaagtttgggaaaaatgggagagagccttcgtgatgtaccatgaaatcagcctagctcacccatattggtggctcccaaacctagctgtacatcagaatcatctgggtattaaaaaagagattcctggacagtttggctccagaccttgagctagtatttggaaaaccctggaagagcattccaggcttcatctcaccctaaagtcatatcagcctcctgtgtgtgggcaccatcttaacacctgccaccacctgagagaactccttgtccttctgcttgttcactattgtatcccaagcatcaagtgtagtgcctagcacagagcaggacctcagagaatacagtgcttgctgaacactggctggtggtgcaaagctggactgcttagttcctgtttcctgcctggagatatgtctcttacctggttgtataccaccttctgggcacactacacttacccggccacagggggttctggctcttacattacaagtcacaacctgatcatcaccattgaagtacaaccctgtgtgagtgatggagggcatgcttatttcaggctcttttacttcttcaccaagtgattttaggcacatgacttgacctttctggacctcagtaacctcatctgcaaattaagaatgatgataaaacctgcctcattggaccatcaagatgataaattgaaagtaggtactcactgggctttacaaattggctatatgaacatcattgttattcatttggtcctgtgagctaaaagagctaatgtatgaggaatagtcacttcattcaaccaatatttaatgagctcctactcagtgccatgtactatactaagtactagggatacaataaaaggaaaaaacagatccattccctgcatgacaatccaaaatagtccattttgaatggcataaaccagcagtctttttgttgttgagacagggtcttgctctattgcccaggctggagtgcagtggctgatcatagcttgctgaaacctcaacctcctgggctcaagcaatcctcccacctcagcctcctgagtagctggcactacaggcatgccccaccacacccagctaagttttgtattttttgtagagatggggtttcaccatgttgcccaggctggtctcagacttctgagctcgagagctccacctgacttggtctcccaaagtgatggccagcagtcttttctagtgataagatatttttaccccttcaagtccaatgtttgcgggcttggcagcctctcctttatattaacagaatcttggaacctctcccaccacaatgtttcctgactatttttccctttgagactctgaatatgtcactaaatcagggcatcccaggtacactcaaaccagtcttgtcatttatggttttcaagagggacacactcactttattcctccctgttccaactcccatttggccacatctgagcctacaaagacactcagaaaacccttgccccagagatcacccagcctgacaaagttccttgtaccccatccgccctcaccttgtcctcaagcatgatgcctcttgctagttctagttacaaaataaaaactcccttgtctataagtggataccaacagatatgactgtgtgtatgtggaaatgagggttgtcttcattagcaataatataccagaagtgctttattacacaaacatccttgaactttactacaaccctgtgatataggcaaaatatgaagaacccaagacttggttgtgatttgctcagtaactcagaggcaggaagtgatgtaacagaaactggaactcaatgtctttgaccccaagcccaatgatctactactaattttgtggctcagtgctcctgttcatcctgaacattttcaggccaatttatgggaagaaggtaacagaagcttgcctggtgaagttgggcagttggcctggtgttaaaaatttactgtgggtaagaatctgtatagagacatatagatgattagaaacaattctaggaaggggatctccaaagagatttcttttaaaatgtgaatgtgaagaaattgagaagtggaaatgggtgggggttgaggagcagtgtctggagtcctgtatttattaatttgcctcccttagtattatttggagttttaccaagagcttgtattacttttattatttttttacaagtaaagtaaagatccaggaaaggaaataatatttttatatgtgattataaggatgtgttcatctcatcaattggaagctaaatttgtttttcctatgaactaatgatgaacaatgaaaactaaagcctcaggtccagtaagtggatgttatgatgagaatttccatccctagcgggggggccatatgactcatgctggcatcgggggctgttttctctcataatctaacacagcagccagaattatccttttaaaacattaatcagatcatgtcacttgctggatttgaaaccttttggtgacttcccattatatccaaggcaaatccaaccccttcccctggtctctcaggttttccacgtccttcatgtggtatggcttgctaacttgatgtgttgaagtgtgtcctccaaaaattcatgttgaagtcctcattatctctaaatgtgaccttatttggaaacaaggttgttgcagatgtaattaagttagaatgaggtcatactggcatagggtgggcccctaattcaatatgactcttgtcctgataagaaggggaaatttggatgcacggagaacatcatgtgaagatgaaggcagagatggggtgatgcttctacaagccaaagaacagcaaagatcaccaaaaatctaccagatgctgggggagaggcgtgagacagattatccctcctagccccccagaaggaaccgactctgctgacaccttgatcttggacttgtagcctccagaactgtgagacagtacatttctcttgttgaagcccccagtttatggtactttgttatagcagccccagcaaactaacacgcctcctctcttaccactcaccctcttctctcacttgcccccagcacagtatctttttttttttcagttacacacacacaccaaatgtattccaccccaggatctttgcactgtatgttttagctttctcaaatgtacttcccccagaccttcacatgactggctccttcttgtcaatcaatttaaatgtcttttcttacagagggcttccctgaccccccagccatttttaattgcatcatgctcatttttttctttggagaagtcatcattatctgatattttttttgtttgtttatagtatatcttcccccaattacaatgtaagttccataggctttttgtttgtttgtttgttttagaaatggggtcttactctgtcaccaagctggagtgcagtggtgtcatagctcactgcagcctccaactcctgggctcaagcgatcctcccacctcaacctccaagtagctgggactggactgtaggagtgagccaccacaccctgctagttccataggtttttttcacccttgtatccccagattctacttagacttaccagacacactataaacattataaatatgtattgagtgaatgggaagaattcttcactgatgggctcattcattaaacatttattgagtctctgctatttgaacagctactgtgatagaaattgacgcacatagtctaataagataggcttcctcccctttgacttcctaaaaggctgtggctcctgctaggttccaatactggtgtagtagaaagagcatgggctttggagtctgacagacctaagttcatatcctagctctgccacttacttgctgtgtggtctgggcaaagcacccaacctctctgtctctcaattgtctcttctgccaaatggagatactaatacctaacccagagaactgtggtaagaaataaataagacacgtaatgtgtgtgaaaagcttagcagtgcctggttggtacccagtaggttctcaaaaaagggaatttccctttctacttcactctagtgagataaccaaagcccctcttctcacagctgtctgcctctctttgggggaaattagcagttctccaggacagcagtagaaataatttggcctgaggggagcccccggcttactgcagtgctctcttatcaaggatctctgaggagccattcaggtggaggtgccccttgttggaaataaacacccagtgtacttctcttcatgctccatatatgaggtagccattcattcattcatttgttcacttattcagcagctatttattgaacgtatattatgttctaggcactgtgctgagtgctgggaatatagcagcaaataacaacacagacacgggccttgtcttcacagtacttgcagtctagtgaagtttttgttgatttgttttccctgtatgcctccagcaaatatttattgggcctggggattctaggctttctctagcttgagaaaatggtgactatggcaaccagacttttatcataccactaccagccgttgccccagatgaccaagtggccctggatctggcgcaggcagagagaacaatgtttgtccttggagttttacaggcttaggaatcctctgcaagttattcttaaaagttctgtgtgttgggtgctctgtttcaagcactagacttcatgcttcacttccatggttttgcttaatcccccacaacaaccttgagaagtagatactgttattaaacccgtttatgttagataaagaaagggaagtgtatgccagtgggtaggtgaagtgacttgctctgggtcacacagatagtaagcggtgagatggcattcaagtccagagctgtatgactcctgagttgttttctacaataccacaatgtttcaaatattgccacgggatatttctgcaaaggaagcattacacagggctgacttgctggaacctaggagagcccttgaaagaaaaagtaaaggccaatcaaactcagtttatagacaggaatcctcaagtttccatatcttcttgtattagttatttgttactgggtaacactattaccagaaacttagcagctttaaacaacacataattattacttcacagtttctgtgggtcaggagtcttggcatggcttagctgggtcctccataaggctgcagtcaaggtgttggtcagggccggtctctcatcagaggctcaactgggcaagaatccacttctaagctcatacgattgttggtggcattaaattccttgtgggctatcagaccaaaggcctcagttcctagcttgctgttgacctgttgccactcagtttcttgctgtattagtcggagttttccagagaaaaagaatccctaggatgtgtgtgtgtgtgtgtgtgtgtgtgtgtgcatgtgtgtatgcatatgcatgtgtatattgagagatttattttaaggaattggctcatgtaattatggaagttggcaagttcaaaatcttcatggtggtctggcaggctgaagacccagagaagaactggtgttgcagttcaagttcaaaggccatgaactggcagaattcactcttgttctggggaagtcaggattttgttctattcaggctttcaactgtttggaggaagtccaccctcattaagaaatctgctttactcaaagcacattgatttaaatgttagtctcatctaaaaccaccctcacagaaacatccagaataaactttgatcaaatatctgggtaccaaaacatagccacattgacataaaattaaccatcattacatcagtgtaatgtgggaaactaaaaaaaaaaatttaccaacatgcttgtcatagtgaacctccccgacatgaccacttgcttcatcaaaggaagatgaagcaaggaagtgagtctcctaacaagagacaccttgcaagattatgtaacataatcacagcatcttgcccacactcaaggggaggaggattacacaagaacatgaattccaggaggcagaaatcacacaggccatgttagagtctttctgccacagtctactccttgacttccaatgattcatgtctctctcacacgcaaaatacattcatttctttctcaatattcctcaaaatctcatcccattgtagcatctgcttaaagtctagaatctcatgatctaaatcaggtccaggtgaagatgcaatgttttaggcaaaattcttctcaatttgttgatctgtaaaatgaaagagacatgtaatctacctcccataaaaccaacataaaatgttgggaaggcttaagataactgctatagacatttccatttgaaaaggagcggggaaatgggaggcatgcactggtccatgacaattgtgaaatccagctgggcaaatgttggatgttccttcattagttcttaagtcctgtttggtctcttggttctgccttctgaattgtccttccttttccacaaaaggtagcacatgtgtgcagctaagtagtttatcagactgctccctgccagtagaattttaggggtccagcagctatctttaattttgtatgctgtctgtctccatccaagctaacagtgtttctgcttaaataacttcctccaaaactttcgaatcttcagtggatttaactggagtttgctccattagaaaaagacatacccacagatctgtttgagataagcccttctttaccttggactccttctgtgatggcttaggtacacaactcttacgtttcctaagaggccctattgtttgagaggttcttggagccacacctttaatctcttgaaagggccctttgtgtgactgaataccactctgatcctttgatctgagattttaacaaaagattgtccagttgctgttggctttttctctatgccatgctttcctagcagtgcttggaagccatttcttaattttagcatcttttgccatctggagagactaagaatcaagtactgatttcttttgggtttaaaagtgcttccctcaatttatgtctctcctctcacattttactataagcatcaagaaaaaaccagcccacagcttcaacactttgcttggaaatcttgttaactaaataaccacattcatcacctacactctactttccacataatcgcaggcaacagtttcagtaagtgtttttccactacttaacaaggatcccccatagccctgtgcctgccacatggtacgtgcttaataaattttactattgctattacaacatacacaatgggaaacagtaacacctatcttatgagatggctgtgagaatttcatgagattatgtgtgaagctgcctgaaatataataggtactgtaaaccaaaaataaaattctaagccccccaaccatttgaatggaccccttctctcagccaagggcattccaaaattaacctgaaaaactacttcaggccatgatgggaaggggaagttggatatgccttattattccctccttccttttggaattcaggcacagctgaccagcactaacatcaacacagagaccttaagtctgatagaacagactctttaagtctgataagaaacatttacaatctattctctctgaagcctgctacctggaagcttcatctgcaagacaaaaccttgatctcttcaaccccctatcataacctagacattcctttctattgattccaggtctttagataataacaaattaccaatcagaaaatctttgaattcacctattacctggaagctcctgcttccagttgtcctacctttctggactgaaccaatgtacatcttacatgtattgattgatgtcttatgtctccgtaaatatatagaaccaagttgtagccctaccaccttgagcacatgttgtcaggatctcctgagggtgtgtcatggatatgtccttaactttggcaaaataaacttctaagttgattgagacttgtctcaggtgtaaactttttggtttacagtatgcatatcccttccctttccttctgtcatgagctgaatgtttgtgcctcaccaaaatttatatgacgaagccctaacctccagtgtggctgtatttggagtaaagaaagaaggttaaatgggatcataggatggggtcattgatgtaataggattagtgttcctataagaagagacatcagagtacatgctcactcctcactcttgtgttctctctctctctctctccctcccccctccccaccccatggaggcactgagaaaggccacatgaggacgtggtgcaactgcccagtgggttcttcttgcctgctactcagatagagtcaatttatcaagacaggggaattacaatagagaaagcatttaatacaagtagagccagctaaatggaagaccagagttttattattactcaaataagcctcctcaaaaatttggaggctacggtttttcaaaggcagtttggagggcaggggtgtgaaaaatggtccttgtgtgtagagtctgcttctaggtgagggccacaggactggttgagggtcagggtggggccatccagttatcagaaatgcaaaagcctgaagagacatttcaaaaggccagttttaggttccacaatagtaatgttaattacaggagtaattgaggaagttgcaaatcttgtgacctccagaaatctggttgtctttcatttgttttacaaaagtggtttggtttgtgggaagggctgttatcatttaaactataaatttcttccaaagttagattggcccatgcctaggaataaccaagggcagtttggaggttagaggtaagatggagttggttagatcggatctctttcactgtcataattttcttactgttataatttttgcaaaggtggtttctatagtgagaagatagccatctgtaagccaagaagagagccctcatcagaaataaactttgctggcaccttggtctcagacttcaagcctccaggactctaagaaaataaattccagtgatttaggtcacctagcctatgatatttggttttggcagcatgaacaggctaagaaatctttgttgggtgaagccattataatctacagatcaaaacccacttttctcagtttgcagctgctcaacagataacattgggacacgtggaaggaacctgaatttaaaaacaattgtgttcatttttctctgattataaaataaacatattgggccaggcatggtggctcatgcctataatcccagcactttttttacgggcggagggtgtccatgttcttggcgtcttgagcaaagaattggaaaaaacgcacaaacaaagcaaggaaaaaatgaagcaacaaaagcagagatttatcgaaaatgaaagtacattccatagggtgggagcgggtctgagcatagagactcaagagccccggtacagaattttctggggtttagataccctttagaggtttccattggttacttggtgtacgccctgtgtaaatgaagaggatatttcctgtcataggtaaagtgtttccatttaatttagttctaggaagtccataggttccttacctccaggccctgttcttctgcctctctttgggagaccaaagtggaaggactgtttgagctcaggagtttgagaccagcctgggtaacacagtgagaccttgtctctactaaaaataaaaaaaattagccgggtgtggtggcgcacactggtagtcccagctactcaggaggctgaggcaggaggatcacttgagcctgggaggtcaaggctgcagggagccatgatcacaccacagcactccagcctgggcaacaaagtgagaccccatctcaaaaaaaataaaaagtaggtttattgtaagaaaaaattagaaatttttaaagaaaagttctaaaaggtttcaaaatcataatgaagaaagtaaaattacctgcagttccttcactcagagataccatggttaatatttgggtaaatttatttttattatttttctatatatgacagtgtatatacacacacaaatagaattggaataatgctgaaccatagtgccttatattcttttttcctctcatttaacatttcttggagcgaattgctttccacagatgtcttttccttcagaatgatttctcccctaggcttttgacttcctgatctccagcctgttttgagccagctccagcctgtttcagggcctggctctaagcccaaaggagctctgtccttgtagacgttccccaggccatgtgactttctcagcaactctgttttcacctgcaaactccctcagggaggtaagaggaaatgatggctctggggagcaggtagaagaagtgaactagaacctgtgactgccacaaatcacagactcaagttctcctttactaaagcacagcaatagaacccaaaccataggctatatgatttgcgtggaaggagcaagggaatgcaaatggactctgggatgatgacaaacgtctgagattaataatgatccaatgagaaatgccaaaagtgaggcaccaaattataccctagctgtgatttcaacttcagcaaaaatatgcgtgggttacacaaaagtgggactgtagtgctctaaacttcttgaggaatggttacattaacattccattgtgttttccatctcattaaatattctttgaaagaattactttttaaaaaacagaatagcttttaaaagacagcctgcttttcacattaagaatgacagaaaatatatagaacatctcaaagaaataatgcaattggagcttcaagtggtggagggtgtattttaagcctgagctacatgaagggacctgagggtgagggcactttaaaacaccaatgataggggagtggggcaggaattgtaagggcatgtaaagagggtgtttgatctgattttaccaaactctctgaagatcagtgagatctcagctggccatacaacatagtgattatagcctgtggcctctgaagtcagatatactgcactgacaacatggctccaatacttaatagctttgtgaacttgggcaagtcaattaagcatccatgcctcagtttcctcatctattaaacggggatgataatagtacctgctttataggcttgttgttaggctatagatatttctgaaggttgcatgaaataatatctggaaagcaattagtatagtacctgagacaaagttaagtgctcaatcaatgttaatgttaactatcatcatcatcactacctgtgttacaaaagtaatagaatttttttttttttttttgagacagggtgtcgtcgtgtcacccaggcttgagtgcagtggcgtgatcatggcgcgcggtggcctcaacctcccaggctcaagtgatcctcccatctcagcctcccaagtagctgggaccatgggcatgtacctgtaccaccacacctggctaattttttattttattttttgtagagacagggtggtctcaaacttacagacacaagtgatcctcctgccatggctcccaaagtgcagtgattacaggtgtgagccaccatgcccagcctaaaagtaatagatttattgaattgatttattgaatatataactaccatgtttcctcaattctatgatttactatttttctaatttctgaaactgggactcatcataccatcactttacatttacatttaaagttgtttttcttcctcactaaaaaaaaaaacgaaaaaaaaaattaaaaactaattcaaaaccatgctctaggttggtatttctagactttaatgtggggatttgttaaaatgcagattctgattcagtgggtctagggtagagcctaagattctgcagttctaatgagctcccaggtaatgccagtgctgctggtccttggaccacactctgggcagcaagggtctagctctctgaactgtaactagtctgagccagaggccataggttggaatagtagccatattggagtcaggcccttgaagcagccttcttgatgtagcaagctcccgttccaataggcatgggactgaggatttagaacagtgctgaatctgtaggttaaaaaaaaaattgtctgactctttaggtaaaaaaaaaaaaaaaaaaaaaatgttgatgaaaagagtcaaactctgtaaaatatttgaaaagatttattctgagacaaatatgagtgaccatggcccatgacgcagacctcaggagatccagagaacatgtgcccaaggtggctagggtgcagtttggttttacacattttagggagacatgagacttcaatcaaatacatttaagaaatacattggtttggtccagaaaggcgggacaactcaaagctggggtgggggaagtgggcttctaggtagacttaaaaattttctggttgacaattggctgagtttatctaaagacctgggatcaatagaaaggaatgtcagagttaagataagaagttgggagaccaaagtttaatcatgtaaatgaagtctccaggtggcctgcttcagagagaatagattgtaaatgcttcttatcagacttaaaggtccctgttgatgttaacgctggagaggtataataaggcatgtccaaccccctcactttctgtcatggcctgaaccagtctctcaggttaaattttaaaagagtgccctggctgaggagaaagtccattcagatggttgggggaccttagaattttatttgtggtttactgggaggtagtgagtgttcccaaattagcatctgtgattacttcataacaaaagagagtttaaagggacgtctcatgtaacagccatgtcagccattctgaattggaactgttttgattccaggagttctgaaaaggagatccagagaccttggccttgttggtttacctctagtcaagccttactaattggaatcttctgcagtcaccccacacatactcaatgtgtaggggacagacttccagttgaggcaggagaatagggcctggaagcagggaacctaaggccaattaatgctgacttcctagaactaaattaaaaggaaaaccccaactttccgcacctaagtaacaaaaggatgcgaggctactccttttgcaacctccccctactccacgcaccgccccaccctatccccctctccgagtattctgcctggcagatggaaaattgaaaatatctctgattggttgctttctgcaaccaatcagacgtttgcataggtgtgtaactttgtaacttcatttcagcctctgatagttgctttccacaaccaatcagactgatcatgggccactacttcatttacatagggtgtatatcaagcaaccaatgggaaacctctagagagtatttaaatcccagaaaagtctgtaatggccctatgctcgggccattcccaccctgtgtagtgtacttttgttttcagtaaatctctgcttttgttgcttcattctttccttgctttgtttgtgcattttgtccaattctttgttcaaaacaacaagaacctggacaccctccacgggtaacacagtctcagatctccacctagagtaagagtaaaaccagcccctccgactaactctatccattcaacaaacaaatacaggtttttctacttccttctcttctcctacttcatacagacaggcatcaaggcctggggactgttaattcataacgtttttgtgatctggttcctcctttgttagtatagcctctagctctctcctgtactgcaacagcctcctactgccccctaccccaacaatttccccaccctacactgttctgcccaatgttcacattaatttttgcctaaaacatctccatttcccacactgctttagtatctttccacaatcattgcatttgccatttactgcgtgaatgaatcttccacttctagtcccatcttactgttgtccttctaagtacaccatcctcattctgaagctacccttgcagaaattataagtgagaaaatgatgacagtgacagagatctgatctaactgactccatcttgcccgggctggagtttagtggtgtaatcttggctcactgcaacctccgcctcctgggttcaagcaattctcatgccccagcctcccaagtagctgggattacaggcatgtgccatcacgcctggctaatttttgtatttttagtagagatttatttattatagagatttatttattattagtcgagatttatttattattagtttcaccatgttggccaggctggtctggaactcttgacctcaagtgacccacccgccagcctcccaaagtgctggtattacaggcatgagccactgtgtcttgcctaatttatagtttaactttgaaacaaagacaataacaacccctccctgaaacaaacctctttcttgcctggggaccagactacctttgtaggactaacaaattagccacaatatttgcaacttccccaattactcttgcagattacatcactattgtagaatctaagattggccttttgagatgtcttttcaggtttttgcatttctgacagctgaccgctccacctggatttggcaactggccctgtggccccactcaggaaacaactcagtgcaagaggacaatttcaactccctgtgatttcatctttgacctgaccaagcagcactccccactccgtagccccctgcctttgtccttgaaaaaccctagtctccaaatttttgatttgagtaataataaaactctagtctcccattcagtcagctctgtgtgaattaaactctttctctattgcaattctcctgtcttgataaatccgctgtatctgggcagcaggcaaaataaactcattgggccgttacaattcacaattgacactttgattcattctgagcttcccacccacagtaccttctctcttccaggaaagagttttaacaatagctaagagtaactactatttattgagtacttattccatgcctagctctgtgttaagcacttgcatagataattatttattacagtagccctataagctagatatcttataattattcccattgatgtgaggaaactaaggctcaaataatttatcccagtatgtttctagatatgtggactctgcccttgtcttttattactgattccttctccttctccctatttaaataccatcttactactttcaaagcatataggaaatacattaactaagctttgattctttgaagtgtttctggattctgatttcataaacacattatttatagtttgcatgttgattgtagggaaatggtacctttaaagcttttgaaggacttttaagccattttgttcatataaattgcttagtcattttctttgcagtctttttcttcaattactattttagatttaaaggttacatgtgcaggtttgttacatgggtatattgcatgatgctgaggtttggggcacaatgatcccatcacccaggtagtgaacatagtacccaatagatagtttcaacccttaccccctccctctctcctacctctaacagtcttcagtgtctattgttgccatctttatgtccatgtgtacccaatgtttagctcccacttacaagtgagaacatgcaatatttggtttcctgttcctgcattaatttgcttaggattatggcctccggctgcatccatgttgctgcaaaggacatgatttcatttttttatggctgcaaagtattccatggtgtgtaggtaccagacttcctttatccattccactgttgatgggcacctaggttgattccatgtctttgctattgtaaataggtctttgcagtctttattactgctgatttgctcggcaaacccttccttcctggatattgtaaaagctgaaccttagccatgcccctgtcacaagcatcccaatcatgactcagaggaaacagaatgagtgcctggtgcttgtgtttctagcagagtgacactcgggcacacagcagtgtctctgcagctctaaggagggaagtgagactgtagggttggggagataaagggctttccctttttgactctttatacttcgatatcacttttctttttacaatgaatgttatttattacttgtgtaagaaaaagcaatacaattatttcttttaaaataaaagacaacaaataggaaagattagagaggagctacagaagaatcataatcatgcaaagctagttatctccagcaataagcaaggagatgccatttgttacctaccagaatggtaaaaaacaaaaaagttgggtaatgcttgtgtttgacaaagcatgaggaggaatagatgctatcctctgctgttggaagaagctcatcttggtataggttctttggggacaattttgcagtgtgcatcagaacttaccatgtatttatctttgactcaacaatactactgctaggagtttactgtatggatatatgctcaaaagcatgtcatgatgtaagcatgtgaggatgtttactgcagaattttttcataatggcaaaaactaaatgtccatcattaaagtttggttaagccaggcttggtggctcatgcctgtaatcccagcactttgggaggctgaggtgggaggatcgcttgagcccaggagtctgagaccagcccgcccaacatggtgggaccctgtctttacaaaatattttaaaaaattagtccagcatcatggtgcatgcctgtagtcctagctacttgagaggctggggtaggaggatcacttgagcctgagagatcgaggctgcagtgagccatgattgtgccactgcactccagcctgggtaacagagcaacaccctgtctcaaaaaaaataaaatgtttggttaaataaaacacagttcatccattaatattaagaacattaaggactatttaaaagcaagaggcagagtgtagtgctgaagtagaatgatctcaatgatgcactgttaagtgtaactgcaaaaaactgaatataacatacaaccatttgtgtcttttttttttttcctggaagaatacacaaaaactgtcaaaagtaaaattatatttgagtagaaggactagagttctgggaccagggagcttttaattttaaattttaacttcccgtactttgcaaatattttatcatgtgcctgaataacttttaaataaacaccaaaacaccgttctaaaacatcaaatgagtcatcgacagacttgaaaagcctggtttatggactaaatgttaagaacccttatcttagggggaagaacctgcccaaatattcaatattcaatttcttcagtctggtagtgcctcaagatcaaaggttctctagggacactgagacactggtggaaggttaatgcccttgaacgccacccttgggctaatactctttgggaaacaagggccaaatgagtattagaacactaggagatagctttaactagccagctgtagatttcttctcttttttttaacatttttttcctgctttactgaggaatgaatgacaaataaaaattgtatatatttagagtgtaaaacatgacgttttgatatatgtatacattgtgaaatgattactacaatcaagctaattgatatatccatcacctcacagagttaccttttctttttgtgtggtgagaacacttgagatctactctctttgtaactttcaaatatacagtacattattattaagtatagtcaacatgctgtacattaattaagtctctagtacatattaatcttgcaccctttgaccagtctctccaccttcaaccactttcaaatccctggtaatcatcattctactctctgttactatgagtttgacttttttttagattccacatatgaatgagatcgtaacagcatttgtctttctgtgtctggcttatttcacttagcataatgtcctcagagttcatatatgttgcctcaaatggcaggatttccttcttttttaaggctgaataatactcttgtgtatatatacacaccacattatctttatccactcatctgttaatggacacttaggttgtttccatatgttggctgttacggataatgctgcatgggagtgcagctaccactttgacatactgatttcacttcctttggatatatacccagaagtggggttgctggatcacacagtaattctatttttaattttttgaggaacttccatactgttttccataaagattgtactaatttacattcccactaacagtgtacaaaggttctctgtactctatcgttgctaacacttaccttttgtttttttgtttttttttttttttgataatagccatctgaagaggtgtcaggtgatatctcattgcaatccctatcaaaaatttaatggaatttttcacagaaataggaaaaacaattctaaaatttgtatgaaaccacaaagatcctgaatagctaaagcagtcttgagcaagaacaaagctggaagcatcacatttcttgatttcaaatgatattacagtgctatagtaatcaaaacagcatggtactggcataaaaacagacacatagaccaagggaatagaacaaagagcccagaaataaacccacatatatatagttagctaattttagacaaaggcaccaagaatacacaatggggaaaggatagtctctttaataaatgatgttgggaaaactggatatccacatgcaataaaaatgaaattggatcttagaccatacacaaaaatcaactcaaaattgattagatacttaattataagacctgaaactgtaaaactcttagaagaaaacttacggaaaaagctccttaacattggtcttggcaatgactttttggatttgacaccaaaagcacaggcaacaaaagtaaaaataaacaagtgggattacatcaaactaaaaagcttcttcatggcaaagaaaaaatcaacaaaataaaagacaacctacagtacaggagaaaatatttgtaagccatatatccaataaggggttaatatccaaaatatataaggaactcatacaactcaataggaaatacaaagctaacaagcaaacaaaaactgggcaaaggatctgaatggacattttcccaaagatgaaatacaaatggccaataggtatatggaaagacgctcagcatcactaatcatcagaaaaatgtaaatcaaaaaccacaatgagataactttttatttcttaattattatagactcatgagaaattgcagaattagcatagagctgtggccccttacccagtttccccaatggggatatatatactttttgagacaaggtcttgctctgtcacccaggctggagtgcagtggcacaatcacagctcactgcaatctcaacctcccaggctcaagcgatcctcccacctcagcctccctagtagttgagactggaggcatgtgccaccgtatctagataatttttttttttaatttttttatagggacagggttttgccacgatgcctaggctgatcttgaactcctgggctcaagagatcccccttcgctggcctcccaaagtgctgggattataggcatgagccaccacacctggccccaagggtgatatcttatgaaattaaagtgcatttcaaaactaggaaatgaagtgactcaatacaattatgtaccacagcccttactcagattttacatttttttgcatgcattcatttttatatgtctttgtgtataactgcattacattttacgacatgtacagatggctctagctcccatcacaatcaagacacagaagtgttttgtcaccacaaaggaactccctgtgctgtttatacacgtactcccgctccttctctatttttagatgttctccatctctttaattttgtcattttgagaatgttgtatgaatgaatcacagagtatgtaatcttttcagattatcgttctttcactcagcgtaattctctggagattcacccaagttgttgcctgcatcaacagtttggtcctttttattgccgcgttgtaattcattgtatggatgtacagtttgtttaaccatccacccgctaaaggacattgcattgtttctagttttttggctattacacataaagctgctatgagtatttgtgtgcaagtttttttgtgtatgaatacaagtttgcatttctctaggataaatttttctaggagcataattgctgggtcatatggtaagaaatcatcagactgttttctacagtagcgttctcgtttttcatttccaatggaaatgtatgagaattccagttactccatatcctggtcagcacttagtattgtcagtatatttcatattagccattctaagtatgtagttatatctcattgtagttttaatttgcatttcactaatgactagtaatgctgaacatcttttcatgtgtttttcgaaccttatcatcttgtttggtgagatgtctgttcaagccttctgccaatcttctaattgcatcctttgttttcttgtttaatttaaagagttctttatatattctgtaattatgaattatttgtcagatctgggatttgcaaatatttcctcctagtcgatggtttgtttgtcatccacttaagattcttcacagagcaaaagtttttaattttaaaaatgtttatttgattcattttttctttatggattgtgcttttgatgtcatgaataagaactcttccccttggagagaatgtagagaattaatgcacttcttctgtaaatgattggttggagtctctggaaaaaccatctgggcctgaatctttctttttctgaagatttaaaaattactgattcaatttctttaatagttatagaactattaagattatctgttttgtctcaggtgagttttggtagtttgtgtttttcaagggacttgtccattatgaagtctatgttatctgacatttagtatatatagcaatgccagctttcttttgattggtgaatctttttccatatatttatttctaacctactcctatgattagatttggaatgactttttttgtagacagaaaatagtatcttttttgtgacacagggtcttgctctgtcacccaggctggagtgcagtggtaccatcagggctcactgcaacctccacctcctgggcttgagcgatcctcccatctcagcctcccaagtagctgggacttcaggcacacaccaccacacctggccaatttttgtattttttgtagagacgaggtttcaccatgctgcccaggctggtctggaactcctgacctcaagtgatccacctgcctcagtctcccaaagtgccaggactacaggcatgagccactgtgtccagccagcaaatagtcttaaaacaaatgacaaaatagaaagtctcaagcaaagaaacatgagatataaagaacaaaatggaaatattggaactgaaaaatacgataaccaaaatatttaaaactcactgtaatgactgaatagcagaatggcaacaataaaggcaagagtcaatatcctagatcaattgaaatcatccagttaaactaacagacagaagacagattttttaaaaaatgaacagagcctagagaactgtggaacaataataaaagatttaacgttcacatcattggagtcccaaaggaaaagctaaaaatcgggctgaaaaatattcaaagaatgatggctgaaatttttacaattttggcaaaattgtaaagaagattcaagaagaagagaagattcaagaagccaagagaaaatcaaacaggttgaactcaaatcaattccagacacatcatactaaaacttatgaaaattaaagacaaaagaaatcttgaaaaacagccctacacaagaacacagattcgaatgacagtggagttcttatcagaaatcatggaaaccagaaggatgtggcgcgaaacttttcaagtgctgtaagcaaagaactgtcaacccagaattctttttttaaaaaaatttcaacttttattttaggttcagggggtaaaacgtgcaggtttgtaacaagggtatattgcatgatgctgaggtttggggtatgaatgatcctgtcacccaggtagtgagcacagtactcaataggtcgtttttctacccttgcccctgtctagtagtccccagtgtctattgtttccatctttacatccataagtacccaatgtttggctcccacttataagtgagaacctgaagtatttggttttctgttcctgcgttgatttgcttaggatgatggcctccagctgcctaaaattctttatctatcaaaagttttcttcaggaatgaaagtgaaataaagacattctcagataaaggaaaatcagcagaatttttcaccagcagaactgccttaaaagaatgaccaaaagaagtccttcatatagaaaggatatgacaatgaaagaaagcttgaaacattgagaatgaagaaagataaacagaatgggcaaaaatacatgtaaataccatagactagccatctcctcttgagctttaaagactatgttagattattgaaagcaaaattaggttgtctgatgtggttcacaatgtaggtaaaggaaatatttaggataagtgaatgataaagtaggagcagaaaagaacctatatggacgtatatttcacttgaagaggtaaaatatcaatactaggaggatgtaacaagttacgtatatactgtgatccctagagcaataagttaaaacaaacaaaaacaaaacagttcaaaaccaaaaactatacaaagatactgtacaggggagggagggaagataacacctacacctggtattacaactttccttctcatttcagatgaccttttttctttttccatttcacagctcacaaactgcaccccttcaacaactgcttccacaagcaaactttcgaggctactagcaatacttccttatttctcaagtatttaacctatgtgaaactgggctaccatttttattaggttcttatctttttgtgcatatcatggatgaaggctttgagcactgtacccctaaccctattttcccccataagccctgtggtttgtattgcacaaatctgcatagcattatgattttgaggactgtatatgtcccattatagtgggacttactgtatctaagagacctcttcagaactgagcaaccactttcagaactatcccattataactcaaagatctccttcaacagtgcctttatatttaatttagagtggctgaccgggcatggtgtaatcccaacactttgggaggctgaggtgggcggatcgcttgagcccaggagtttgagaccagcttgggcaacatagggagacctcgtctctaataataaaaaataataataatgattaatagagaggccaaaactgccctttaagtgcttgtaaagtagatttgttccttatttacaataaaaaagtaaagctcaaatataaaaaagtcaggacaagtttaaaaaaccagtatcattgatatttattgagtgccccctatgtggcacgtgttgggcatacattacctctagtgcacacccacagcaatcctttaagggagggattttcaacttcatttcacttataaggaaaacgggctcacaaaaggggcaggttcttgccaacatcattcattgatgcaggtgcattctatactccttttgctgcaccacactggctcccaatgtgtgagtaactgaacggaccctataagtgcaggtactagaatgcttgtaattccctagcaccctgcatgatgtttcatgcttccatgcttttgcctatgttgttcctttgcctggaacacctttacagccctttattgcctgggaaattcttggtcacccttcaagaattttgtattcctagtgtttaagtatccagcctggcatagagtaggcactcagaaaatatttgttgacctgaaatgaatcagaatacagtgttgttcataggtagccctcattattcaggtgcttaagaggcagacatttcctagtacagatcatcttattgtttttcaagggggaggatggtcacttaatctgggacacccaagggcagcaccccaattttgttatcaaccaagggtcttgtcttttatctctcatcactcctccacccccaaatatattttcagtacattcacagattcttatacttttggtgatggcttctgttaacactagacaggttatttaaacctgaatacccacttattactccacagttgtgaagatccacttgtagttaccacagtgtttgtggccctagccagggccattccccaaactagaatcaagctacttgggaagtaaaatcagaagtttgcttggtcaatgtggagtcaaaacaagagaaaaggagtcatttggagaggctctgtcactcaggctcttgagaaaccagcacactgattgaaacatttatctcctatatccagcatctcttttccctaggatagtactggataaacacccaatctattttatcttttggaaccctcatttttctatgctggcccctcatcttctgttgacacatcctttccttagagtgctaaaatcgtttgttaatttagttgtcattcccagtggtctatagggatagtctgcctcgtcctattatatatgaccaacagctccacactgtttcgaatctagcaatcaactagattccctttgctgaaaactcaataataataataactaatatctattaagtactttctcattatcatgtactgtgcaaagcactttacatgcattatctcatttatttttaacaagagacactactattatccccattttacagataaggaaattgaggcaaagtatagttaagttacttgcctatggtaagtaggcaatttttgctcttaataagtggcgaagtcagaacttcctcccgtgtaacaaaagattggtaaaatttactaatcagtaaattagtaaaagaaactggatcctagaggctgtcttgatctaaccaggagtatgtttgtccatttgtttacaaaatcttaaattatctcactgtttggcacatctcatgtgcatgaaattctgtaccaatatggttactcctcacctatccaagggtgagaggaaacataggtctactctggaagataatccttactaaaatccaaccaaactttgctaagtggactgtgacaagattataaatgatatttaaaaaaaaaaacatttggtcatcaatttaaggaaataatttgcctacacagatttttgtcatttcaaaaaggtaatatattccactctcatatggtccttagaattaaagcatagcaaatagaaaaggagaggaaaagaatataattgagtgctaaggcagaatatcttgccagatgtaatgaagatagattatacactaaatatgtgcatagagtttcatagagttaaccagataactgcttgtatttttcacttacacagacaaaatagattttgcagttaccagttgtattaaatgcatcaaataaatctcctaaaattgatactataaagtgccaccttaagttatctgggatgcaactgtgtatcattttaaaatggctttcacaaatgtatttatttatttgagacagggtcttgctctgtcacccaggctggagtgcagtgctgcgatcatggctcactgccgccttgaactcctaggctaaagtgatcctggccattcagcctcccaaagtgctgggactacaggatgagccacagatttatttatttaaacataacatgaggaaggtattaaaacctttcagattttgggaggtatgaagaaggtgatgcttagaacccttcacaaggattccactagaagtggattaagtgctgtgctttgtggatgtgacaattagtcaatgccaccagcttgatggatctttctttctgtaccaaatcccaaaaaattccatgctttcagtgatcactaaaagctgagctccatcttcagctaggtgggttaagaattcaatgctctcattcaatcccagagtggtccagtgactgctacaacacctggcctataggtgatgcttattaaatattggttgaatgaatggatgaatgaatgagaaaagagatctgggagcctgacttgcactgggtaaaatcccaacagactgcccaacagagcaaggtgcaatattggggaacacacctgcgaagtcagtggaacctacggattgaatgttcagtgtattctctcctcaaaaagaaagatgacttcggaaatctcaaatgctgcttctgttccacagtagtaaacaaagggagctgtgtaacaagatctgagattattatcaagttctacgatcctgatgcagccatctccactctaagggtgtttcttcccacaatttatacatgtcagctttcacccttctcattgactagaatgaaggtaagtggtgagccaatctgaccatgaagatgagagtaatgtcagagagtggatggagcaagaagacagaagcaggttggatccctgacaattttaaagagtagagccaccgtaatggcttagacctttatgtgcgggaaaaataaactcccatcttattgaagccaccattattttggatctttccattgtagaagctactaacattgtaccactttctgagaaagagtttatttctgcagattactgatctcatgcattttgtttgattcttccaattcttactcatgcagggtaactttacatttgaatgaaagattaagtcaacaaatatttgttgagaactcacctgtgccaggcattgtgctaggagaactgtgttgtactgtgtgtgtgctatgaacatctattgcacagacctgttgcaaagattaaaggtgtgtgattaaagctaatgtgtgtgaaaatgcctagagcaaatgataagcacagaacaagtacgtatgtgttttattcggaaacccacattgacttttgctgcttttggttctcaaagataagcaggtacctctgaaaagattgttaatttctgaattcagtatcagtgtcagtgggggagaatacctgtaggtctgaaaaacaaaatctctggtgagagaggcacttgtagtagaacaaataagcatcagaactaatgctaattctaggcacgatagatccatttcttttcttttctttcttttcttttcttttctttccctttctttctctcttccctccctcccttccttcttctttttctttctttctttctctttctttctttctttctttctttctttctttctttctttctttctttcttttttctttctttctttctctttcttttttcccctttctctttctttctttctctttctttttttcttttcttttctttcttcccttttgatagagtttccctctgttgcccaggctggagtgcaatggtgtgatctcagctcactgcaacctccaccacctgggctcaagtgattcttgtgcctcagcctcccaagtggatggggctgcaggtatgtgccaccacacccgactactttttgtatatatgtattttttgtagatggggtttcgctattttgcccaggctggtctcgaactcctggcctcaaatgatctacctgcctaggcctcccaaagtactgggattacaggcgtgagccactgcgcctggccagaaaaggagactattttttataagggattacagcctgcaaagtggtcattacacaggctgggaaacatagcctgtggaaaagaccagaggcaggcacctcaaaggagaagggtttgtacaggaatttaaggtgaacaagttggccaagtatacatatttagcaggttacatgaagagctatgaatattcatgaaggtggtcctgatgcatgtgtattgaacaaaccatgtatataacatataatccatggtcactttggagtggagacaacatttaaatgtattataattaggccccatacttgaaaaggtgaaccagggacatggaggtgctcaagtgtgcagcctctgtaaaccagccagaaccagtctatggctaatggtctcttatcaggagaaagttactgaaatcagtccgttgttcaataagctgtaattatggtttgtggaagaaggggtcagtcagtgtctggtggtggattagctgcaattgttttaatattgcttattttgaagccagtgcttgtttagttgctagagaaaaagaaaaaccttgcagcagtgagaacagagtttattctttaagtgtgaggagtacatgacttcacccttgcctggcatggccttaggtcctgtttataatttggtatcttattgtcacaaagagcctgtcctgtcagtcttatgatctctattttaacattaatgctggtcagctgttgtgtctaaaccataaaagggagggggtgtaatgcggcaagtctgacctcccatcctatcatggccaggaactcagtttttgtttttctctggggctcccttggccaagaggaggtctgttcagtcagttgaggggcttaggatgttacttttagtttacaatagcacataacagagggttccaaattgaggagttcaaggcaattcattgaattgtagtgagtaaatattagaatttgtttaatattcagttttaacttgaatctataaagaataagaaataaataataaagtacaagaaactatgcagttagaatggcgatcattaaaaagtcaggaaacaacaggtgctggagaggatgtggagaaataggaacacttttacactgttggtgggactgtaaactagttcaaccatcgtggaagtcagtgtggcgattcctcagggatctagaactagaaataccatttgacccagccatcccattactgggtatatacccaaagtattataaatcatgctgctataaagacacatgcacacatatgtttattgcggcactattcacaatagcaaagacttggaaccaacccaaatgtctaataatgatagactggattaagaaaatgtggcacatatacacgatggaatattatgcagccataaaaaaggatgagttcatgtcctttgtagggacatggatgaagctggaaaccatcattctcagcaaactatcgcaaggacaaaaaaccaaacactgcatgttctcactcataggtgggaattgaacaatgagaacacatggacacaggaaggggaacatcacacactggggcctgtcatggggttgggggagggaggagggatagcattaggagatatacctaatgttaagtgatgagttaatgggtgcagcacaccaacatggcacatgtatacatatgtaactaacctgcacgttgtgcacatgtaccctaaaacttaaaatatagtaaaaaaataaaaaagaaactatacattattaatatttaatataaggattgatagtagcacttttactcagcccttatgcaggatggtgacctgttatgtactataggtgaggtatcttcagaaaagagtgggagttccaacgggggtagggattaagagtgccatactctctctgattttttgggaacatttttctattcacatgagctcaggtaagtggaattatggatttatttatttacttcggtttttttaaaactaatgctcacaaaatggacaaattgcttcagaagagacctgcaaagaagctatggattaaagataaaataatgtggccgggcgtggtggctcacgtctgtaatcccagcactttgggaggccaagacaggtgaatcacctgaggtcgggagttcatgaccagcctgaccaacatggagaaaccgcatctctactaaaaatacaaaaattagcctggcgtgatggcgcatgcccataattccagctacttgggaggctgaggcaggagaatcgctggaacccaggaggcggaagttttggtgagccgagatcgcgccattgcactccagtctgggcaagaagagtgaaactctatctcaaaataataataataataataataataatgataataatgtaaactcatgcaagacaaaagaaaacaaagaaaacccaaaacaaccaatcaggtcaaagagctggcacttaaactcctactaagtgaactttatcagtcacactacaagttaagggcattgataatctaatgagatctgacaagacattgaccccaacattcagcctttttttttttttgtcattatgaaaacttggcatacattcagcacttctaagatgttttgaaatctggatatacactcatgatcattagaaagaaatcttgccctaagtgcttggattttgtaactcaagattatcagttactgacagtaagaagctatcatgatagttaagacctctaaaaataatatttatttcatttttatcttattttagaatttcaaattgagatattttcaatttgtttctcaatattttttaactgattgtgcttggaggtcactggtattgagagaagagcatgggtattgaagtcagagggatctgaattcaacttctgtcccctactctctatatccacagccaaacaaggcaagatcatctccttcctggactaacacaatgacctcttaattgtccttcttgacttccctctaattctcttacgtcaaggctatgatcttactgggggtaccattcacatagaatacaatgtgtgctgtcccggcaaccctgcggccagaatcactttcctaaaacaaatccactcttgccactctcttttagaagcttttattgaattcctataactctgaaccaagggttcccaaaataggatccaagagtccttgagagtccttgagattcattaagcaggtccacaaggtcctcctttttctaaccacctatctgtgtgaagccagattctttttcatatactttaacgaaaacaacataatgcaacagattgaatttatttatttattttcctttctctttttttttttttttttttttgagatggagtcttgctctattgcctaggctggagtgcagtggcacaatctcggctcactgcaacctccgcctcccagattcaagcgattttcctgcttcagttttcccagtagcttggattacaggcatgtgccaacaaacccagctaatttttgtatttttagtagagacagggtttcaacatgttgggccaggctggtgttgaactcctgaactcaagtgatccacccgtctcagtctcagcctccaaaagtgctgagattacaggcataagccaccacacctggcctgaatttagaagcagatataggaatccaactgtcatctattaaagagatctggaaatatgtaaaacaataccacttttctcacttacttttcagttttggaaaacagaaaatattgttatttttcacaaaatgctattcatgctaaaatatagctaatatatagtttattgttgttattttatttttgagatagtgtctcactctgttgcccaggctggagtgcagtggcataatctaggctcactgcaacctccgcctcctgggttcaagcaattctcctgtctcagcctcccaagtagctggggttacagaggcatgccaccacacccagctaatttttgtatttttagtacagacgagattttaccatgttggccaggctggtctcgaactcctaacctcaagtgatctacccgcctcggcctcccgaagtgctgggattacaggtgtgagccaccatgcctggcccattgttgttattttaaaatgaataagtaaatacttaaaaattttttcagtttaatttctaatgtagtaaaaatcactagatacagcccatataaacaaaagcttctggggggtcctcaataatttttaggcatttactgtgaaagggtcctaaagacaaaacgtttgaaaactgctgttctgaaaaataaactccaaaatccttcagcaccaaggcttactaaggtttttctgatctgatgcctgcctactcattggccttaccactgccctctagaagtttcctgtctagttatacagaactgcttacagtttccctaactagtacaactgtctctacctcttgggccaaacactggggacttgtagggttattaattaattaatttattaatttatttatttatttatttatgtagagatggggtcttgctatgttgcccaggctggtctcaaactcctgggctcaagcaatcctcttgcctcagcctcccaaagtgctgggattacagatgtgagccaccatgcccggccttgtagggtcatttctgaagagagagggcctaggaaaaaatcttagtgctagtaggagtctcaaagactctattggtcagggttcttggtgacaaacaaacaatagaactcactctagctagttttagtagaaaaataagaatttaagtatattaagtaactcagaaaatttgaattgtccacagaaccaaataaattttgtctccaaaaacaatagcccagttgagctcctctgggagaggcactattgctctctgtaggtaggcttggtgtagcttcaacaccaatgcaggcctgatgcatcactgcaacacaatttagcaccactgcctgtgaaagctggctgtctctcctccacatcctccacagtggactctgagcagtgcctctttcatggcatgctcttccaaattgaattctcttccaaatctctattgggttcagtaggctctaagtcatatgcttgtaacctgttggcaagggaagcaggaatgcagatgtctggttcctgctttgggaaattgtgagctcataaagtagcagagggctcagacaaaggaagagggctcaaggatgtcacaaaatgataaatttccactccagagaccataaaatccaaccccctggtttttcagatggggactgactttcctaatgtcatacacctctctcatttgtgacagagctgaccctggaagccatgtgtcccttcgatgctctttctaccaacaagcattgtttcccaagtgtccaactgtgtcatgtgcaatattcagacaggatgtagtcaggaaggaaaccaaacaaaagctgatatttgttcttttattcattcaacataaatttcttgagcacctgatttgtgccaggaacagctacacaatgatctccagaaatcactctctggggggtgaaacagacaagtaaacaggcaatttctatacaatgttagaagtgctataatagagaagcataggtggccctgggtacacagagtaggatccaatggcgtcaaactcttgttatgggaggttttccatcagacaaaaacctgaatagcatattcctgagattttacatgggtttttaatttcaggtgcttaagcaatgtaaagattactcacaggcattttcagacataggtccgatgatgttctggaagttgcccaatgttgcacagcctccatgaggcatacctcattggaaaccatattctgttgtatggctgacttctgggggtcctcagtttcttcatctgtacaatgaggatgatgactactttgatttcatttgatctgaggaccaaataatatagtatcttcaatcaaggctcttctggttgctagcaacagaaacctacttgagctagcttagttaataggaaggcttattataggatataaggagtttcatggaacacaaggtcagtaagtgtagccatgtgtcaggagggactaaagccatgaactggaaactcaccaggaatcaaggcagttctgtccctctcagtctgtgtgttcttttgtctatccatatccactccagtctcttcatgatcctgatttctctgcttttccatgaccttgactaaatatagcttctccacagcgattggatttataagtcttgggtttaagtgaccaaaagtgctgactggcatctctgaatccaattctaaattttcagggtagaatctgcttgtcccagtttagatcagggatgctgtgtggttcaatcagttccacccaggagtcagggttgcgacacagctgccaggaacccacccctgtggctggtggctgggagagatctggttcttagagaagggggattaggggcttggcagacccccccaaagcagataatgtatgagaaggcatgacgacagaaatagtggaggatcccaataatggccatctatttttcctgcctgcctgctacctgttctttttttctggtaatagtttttattctttgggctctgagtggtggacacatgatccaagttggattgatcatagtacctcataccctggccaagctcagtatgcttgttccatttagcatcattttggaatccttctccctctccataatctggccatttaactcctcccaccctttgaggctttacctcaggttcagtagtgtttatagtctgtctcacacagttgcaaggattttatgttctctgctgactttgagcctcgtgtccctaatgagatatataggaaagtcttctaggagtcaactgggtcaccaggtggggacataaacctttcccagaagttccgtagctgacctccttttatacttcactggccagaactgagatcaatcactggtgagggggaagagcactgctgtaactgttgtaaactgattatggctcatctagtgctgactcacctcctgagatcaagagatctctgtcaaacacttgatcaatgttgggctgctattagcaagaagatagaagaataaaattggccaggcatggtggctcacacctgtaatcccagcactttgggaggctgaggtgggcagatcacttgaggtcaggagtttgaaaccagcctcgccaacatggtgaaacctcatctctactaaaaatacaaaaattagccaaacgtgctcacttgaacccaggaggcgaagattgcagtgaaccaagattgtggcactacactccagcctgggcgacagagcgagactctctctcaaaaaaaagaaaaaaaagagagaaagaagaatgcttgccaaaagtgtctgttccagactgtgacctctaggaagatatgggctacttgtggtttactctgtctgctatcagtttccttcaacttgcaggccttctcatgcagcccctaatttccttcctctgtcctcctcccattgcatgcttgcatgcttcagggcaattcatggcttctagcctattctctagaaggggaacatgtctgagaccctgcggctctggtgaaaaggaatgggtgtagcaaagaagggtaaatgaatactttcaagtctcttttttgcatgaccttcttaccttattgcaagaagaactaggtagtatctgtctgacacacatggccacatagcatagggtaggagcagggctcctggggcagatctcctgcattccgactctagtgtcaatagttgtggtaacttaggtcaagtaacttaaactctctgtgcctcaattcgtcagttttttttttttttttgagacagggtctcactttttcacccaggctggaatgcagtgttaagatcctgtttcactgcagcatcgacttcctgggctcaagctatcttcccacctcagttcctcaagtagctgggactacaactgtgtgccaccaaggcatgctattttttttttttgtagagacagggtttcaccatgtaacccaggctggtctcgaactcctgagatcaagcaatcctcctgccttagcctcccaaagtgctgggattacaggcgtgagccaccgaacctggcctaattcatcagttttagcaaggacaataatactatgtatgtacctcatagggtttttgtaaagattaaaatgagataataaatgcaaaacccttagtatagtgcttgcatatagtaagtactcactaaatatcactacttattacagtaactattattcatgctactggaaaagtctggaaagaaacaatacttgtgtccaaatggtggatgctgggggatttaaaaatttttcttccttatactgttctgtatgcaaatgtcctacaatgagcatgtactgctttaaacaatcagaatgtaacacaagatatctcattaaaaatcaatattcaaaccctcacataaacatgaaactcaagaaaggtcttaagttgggacatttgaaactatcagaaagaatctacctgctactgcctgtcagcacaactacagtgtagactagtcactatacctcttagactacactcaagcagggaaaagcctcagctggtatttcacagcattcctaggaaaaagtgatgaaatgatggatgggaaaatattttgcaaaactgaaagcatatagggatagagaatataatgataattaggttcagattctttgaatttagctaagccaaagagggctgaggatgctaaccactgaactttttgaatgggtaggactgggtcaagagttaccagactgcaggctgggcgaggtggctcatgcctgtaatcccacaactttgggaggtcgaggcaggcagatcacttgaagtcaggagtttgagaccagcctggccaacatggcgaaaccctgtctctactaaaaccataaaaattagccgagtgtggttttatgcctgtagtcccagctactctggaggctgaggcaggagaattgcttgaacctgggaggcagaggttgcagtgagctgagattgcaccactgcactctagcctctagcctgtgcaatagagcaagactccctctccaaaaaaaaaaaaaaaagagttattaggctacaagctggttgggcattttgagacacagtgtcctactgtgcagagcaaggctgaagctaggatagatggtggaaatattggacctgacctgaaggcatagggaagataggaagaaggaagctagcatttgttaggcacctgcgactgtcagttactttacataaaatctcaaggaacttaatcctcacctccatgacaaatgtcagagggactttctatcactggaatatggccttaagactttgtgcccaagtcatgaaccatcttttcagtcttcttctctcagatgcctcttatcgtggttttcttgcatggaaatcccattaaacaactatcctgatattcattccatctcctttctttctttttttttttttttttttttgaggcggagtctcgctctgtcaccaggctggagtgctgtggcgcgaccttggctcacggcaacctccagctccctggttcaagcaattctgctgcttcagcctcttgagtagctgggataacaggcacgcaccatcacgcctggctaatttttgtatttttagtacagatggagtttcaccatgttggccaggatggtctcgatctcctgacctcatgatccacccgcctcagcctcccaaagtgctgggattacaggtgtgagctacagcgcctggcctcattccatctcctttctaaggtaagtaggtgctagacttggggtttttaataattggcccactcacgggagagccctggaaaaatggcagcaggattctccccacttgggaagaatttggtgagagccaggcagaggatcggggatcaactcagggaccggagtaaagttgcaagagggtcccagttccagcatgttgctcaagtattgagtggaaaaaccaaagcaaaagactgggcctttgtagcaagttgatacctggggtctgaagagaattacagaagcaatgaaggcaatgggaatgcttacaatctggaggccagtgtcaattttactaggaaatagtgaagtaagaagaaggagtcaaggaatgacaaacagtctttttaggcagggtgcagtggctcacgcctgtaatcccagtactttggaggccaaggcgggcagatcgtttgagctcacaagttcgagaccagcctgggcaacatggaaaacccagtctgtacaaaaaatacaaaaattagccggacatggtggtgtgcacctctaatcccagctacttgagaggctgaggtggaaggatggcttgagcccaggaggcataggttgtagtgagccaagatcctgccactgcactccagtcggggcaacagagccagaccttgtctcaaacaaacaaacaaacaaataagaccaccaccaacaaaagtcttttcagtagccttacatattgatttaatataaataatcaagaataacagatacaaactgttgcacaagtttgtatcttgtgcacaaggggctgcacaagtctcaagctgagagccagcaagaacctacttgtcctcttccctcagcaaacagcatctacctgttctacagaatctatgtgctactgcctgctatgaaatagctattttgcccttcactttgccacttccatgcccttcgtaccctggagaaaaggacagggtacgtaggcttgtcatgacatgggccaacaggaggtacccagtgaggtctcagtcttataggccactcccagagaatgtagctctcagctcccagctgtgctctgctgccctaggagtggggatgcaggtgagaactgctgtcttcctctgggacaggcctcctgcctctcttcatcctcatctctctcctcagccttgttccctctggacttgaagctctacataggcagaccagacaatgctgggctttcaggacctcatagattggattcctgagggagaggtcttgagaaggggatccacaggccagccccagttggtgggcctggatgctggcatctgagcatctggacatcttttagttctcatgctgggggctcacagtgcaggaagggtgtgtgatccagtctggctactccccgcctccaggccatgagcttgatcacatggccagatggaaagcccccaaatgattgagtgtcctgtgcgggaactctaaagagggagatgagaaagacacaaagaactccccctagtcctgagctcaaagatgtccgactgtactatagcatgtaggccaatcttgagtgacaaatactttgtggccatacccttgagaggtagaatgggatggaggtaatcagtgcggtgattgatgccttgtatcagctgctggtccatcaggaagggctccttgtcctcatccctgctactgaagtaaagtggacctaggaatacacatagtacttgccaccctggctgggcagaaatgcctctccctggtaggtgaggttgtgcaggtgagacagcaggtctcagggctcccagttatgcagaaataatgctaggactggggtagctcctcaggatggaccagagtttctggaggggaaggaagagaagcaggtggctgttaaggatgagggagatcatcaacctagcatcccactgaaccttcagattcaattcaagtttttgcctcagctttccaaagtctcaaaggttcttaaccaggagagtgactcgtttaaattatgacaagaaccagacagcctaggttcaagtctgggctgtaccactcactagctaggtaaccttgagcaaggaattttaacttctctgggcctcagtttccttaaaatgtaaaactgggaaaataatctctaccttaatatggagattacatgagaaagtgcaggaaaagggcccaggacggagattggcacaccggagacattcaacaagcagattactactattattactgaaagaaaggccgaataccttagctaagctttcaggtccctccatgacatggccgtcccctctgtttcagccttatctcccacttctctgttggggctttcagctccaatcctgtgggattgtttcctctcccggcccattcacggttccacttctgtgccttcgatcatgctcttccccagtttaaattgctctttctcctctttacctaagcaaatccatcccatccttcacattccctcccgcccagaggcagagctgcagggcaccagagggaggtgagcagagaggagtgaggaatggcagccagctgccccttggatgcattgtagagttcatcctggctcttgcaaaggaagtggaaaaacaagccctgatggagatgggcatggagcagaggtgggatagtggtgcagaaaaacatcactgggatttttttctgagaactcttggaccttagactaacacaaagtgggaagggattgcagccttgttcagttaacgggcccataccctcccaacaagaatgtaagttctcagagcccaacttgtgacagcatcaaggtccatagaaatggagagcttccgtaccttagaggtgaggccaaatggagttaaattttacagaagcctgcttttaaatacttcaagaaagagaatttaatgggatgcacacacacacacacacacacacacacacacacatgttctgtcttatatgtatatataaacatacctttatattacataatatattgattatattatatagtatttaatatattaaggtaatatatattatataatatataatgtaatatataaatataatatgatattataatgtattatatgtgatatataattatagaaaattatattatatataaatattataacatatattatattaatatagtctagtataatatgatagcttattatattatttataatatataatacataaatattacaatatattgattatatattaattacataatatattatagaatatctataatctattatagataataggatataatattgtacagaatatatattatatatacactaaccacttatatttatatccttgttatagctaagccttgttatccaaggcttctaggatgttaatactaaccagatatctggttaacatccaaaagatcttaattaggaatacacactccatgtgttgtttctttgaagaagcccatacttcagtgggctgccacaaatacttaagatatttccaattgacaccagaggctgtgaaatagcataaggaaaatcacaagtgatttttccttggtgaaatgaatgatgttcaactgatgatgttcaagacatgtggattggctagaaatattatatgggcactacacatgtatatgcatagactacaaggatttaaccagcctactggacagatttctcttagcttaagtttcccaagcagtccagtgttcagaggctactgcatgatggttgccttaatcctaccactaaaatatgtcacacgcatagtgctgtcagggcatctaaagggacagagatctgggattttgtgaacttatagaacagtccatatatttgtaagtgcttgctctctccttcacactctatatctggtctgtcagcgagtcctaatgttctaccttcaaaatatttatccagactcaacccactttgaccatgcccatggccattgctctgctgcaagccaccatgaatcacctttaactggatgattgcaagagcctgccagctgcactccttgttccactcttgactccttttagtgtgtctctccatagagcagccagaatgttccttttaaagcatatgtcacataagttgacaagtaacatcactcctctactcagaaccctctgatggcttcctgtttcatttattagaaaagctgaagtgctaactctggattccaagatcctcactgatctggtgaccctcactgatctggtgctctcccacctgctgatccccattgttagccttgttttttccattactgttctttccctcattcacttccctccagccacactggcctcctcactgtccctcaagcattcatcttttcaaattatatggataggtaggttatttatccacaaatttcacttcaaggtaacaaaagggtgttacaaattatttgctataaaaacacattgagtttggtggatcactatccatcaaaagttggatagtgtttaaggatcactatcttagagtttccttcctttacaatcctcccttcttcttcatgaggctatgtcctggcctctatttctctgcatttcactgctgacactctctattttatggcttacgtttccctaaaaatgtatggatagtctgtggtagccagttgtattagtttgttctcacattgctataaagaagcacctcagactgggtaacttataaagaaaagacatttagttgactcacagttctgcaggttgttcaggaagcacggctagggaggcctcaggaaacatacaatcatagaaagtgaaggagaagcaggcacatcttacatgagacagaggaagagagagtgaagggggaggtgctacacacttttaaacaaccagatctaatgagaactcactatcacaagaacagcaaggaggaaatccaccctcatgatccagtcacctcccaccaggcccctccttcaacactggggattacaattcaatatgagatttgggtggggacacaaatccaaaccatgtcactagcctccaggatggcccccaataattcctccctcctggtattcatactattgtgtagccccattccacactgcataggattgacctgtgtaaccaatagtatattgtggaagtgatggagtgtgacttctaaggctagatcataaaagacattatggcttctgtatttccctctcggactactctttctgcggaaagtctgctgctatgtgatggggacgcttaagcaagcctgtggagaggtccatgttatgaggaactgaggcctcctgccaatgtgcagcaccaatttgccagctatatgagggagctaccttggtaatatatccttcagctccagacatgccttcagaggatggcaaatgccattgacatcttgactgtaatctcataagaaacagagccagaatcacctagttaagctttccccagatttctggccagcataaattgtgtatgataataaatatatatatatatattttttatgacagggtctcgctctgttgccggggctcgagtgcagtggcatgatcactgcttcttgcagtctcaaactcccgggcttaagtgatcctcccacctcagttggtgtgcgccaccacgcacaggttagtttcgtgggtttttttttttttctttttttttttttttagagatgaggtctgtctttgttgcccaggctgctcttgaactcctggtctcaagcaatcctcctgcctccgcctcccaaagtgttgggattatagacgtgaaccatggttcccagccagtaataaatccttgttgctattttaagccactaagttttggaatattttgccaaaggtgattgacctttttatctttttatacctttcatagattgtcagtttctcctgaatagaatataagctctagagggtggaaagcttgtctgttttgtatccccagagtgtaggacaatgcctggcacacagcagctacccaataaatatcaaatgaatgagtaaattacctttggccaaagagatatcaatattaaaaagaaaaatatgaaatcgtcattatttgttaaaactatcattatttacgttaaaaattcaaggcaattaacgtagaagccattagaaccaataaatataattcaacaaagtggcaaaatacaagagcaacatacaaagaaatgtttttatattatacatcagcaataatataccagaaaaatgtaatagatgaaaatctcagtcacaataacttccagaactctaaaatgcttagggaaagaacctagtagtaaatgtacaaaatctagatgcagaaaaatataaaactttactgaaggtcataaaaatagtatctgaatgaagtgaaagctgtgttataattcaacacggtaatttaactcacttttgtaaaaatgtcaactaccttaaaaatctgtaaatttcatcccagtaaaaattgtaatgatttttttaaatagaacccaacagagtaattctaaaaaccacctggaagagaaaatattcaaaaatagctgagatgattttgagaaaagaacagtgggaggaaactcaccctaccagatttcaaaacctagaatagaagggcagtaattagaatgaggctgggcgtggtggctcacccctgtaatccagcactttgggaggctgaggtgggtggatcacctgaggtcaggagttcaacaccagcctgaccaacatggtgaaatcccgtctctactaaaaatacaaaaaaaaaaaaaaattagccaggcattgtggcatgcacctgtaatctcagctactcgggaggctgaggcaggagaattgcttgaacccaggaggcagaggttgcagtgagccgagaccgtgccattgcactccagcttgggcaacaagagtgaaactctatctcaaaaaaaaaaaaaaaaaaagtttagtaattaaaatgatgtgataatggaacaagctttacaaataaataagtggatcagaatggagtccgaaatagatccaaatatgtacaggagtccagttttcgacaaaggaaaaaggatgaagtattcaataaatggtattaggaaaactggttatccgtttaggaaaagtaaagttagatcttcatctcacaattttcataaaagtaaattttagatagattaaaggcctgaacatataatatgaaattgtataagtaaaaaagaaaatacaggagagggctgtaagccatgaggtagggtaagcataaaacatacagatacagataaataatattgactgcatccaaaaaacaaggcatctataagacaaaaacatgaaaacaaaagtatctcatggtggccaagaaccttcaaattacctaatgtttgtttttgtttttgttttttgagacagggtttcactctgttgcccagggtggagtgctaaataattttgactgcatcaaaaaatcaagacagctaggcacggtggctcctgcctgtaatcctagcactttgggaggccaaggcaggtggatcaactgaggtcaagagtttgagacctacctggccgacatggtgaaaccttgtctctactaaaaatacaaaaaattagccagctgtggtggcgggcacgcgtaatcccagctactcgggaggctgaggcaggggaatcgcttgaaccctggaggcagaggttgcaatgagctgagatcgtgccattgtactccagcctgggcaacagagcaaaaactctgtctcaaaaaaaacaaaaaacaaacaacaacaacaaaaggcatctataagacaaaaacatgaaaacgaaggtatctcacagtggccaagaaccatcagattacctaatttgtttttgtttttgcttttgcttttgttttttgagacagggtttcactctgttgacctggctggagtgcagtggcatgatcttggctcactgcaacctctgcctcctgtgctcgagagatcctcccacctcagcctcccaggtagctgggactacaggcacgcgccaccacacccagtgaatttttgcatttttttgtagagatggggttttgccatgttgccccagctggtcttgaactcctgtgtacaagcaaccgcctaccttggcctcccaaactgctgcaattacaggggtgagccaccgtgcctggcctcctaatatttgtcttttataagttgaatattaaagaatgattttgacagattttttttgttttgtgcttttaagaaatgaagaaacaacctttatcttattttttttagcagactttaatttttagagcagttttaggttcacagcaaaattgagtggaaagtacagcgatttctcatattgccttatgattttagatagcaatgcctctatttttgggggctacttgaaaatttcaatatctgtgttcatgaagacagaatctcaatcaacaattcataaataattgtggggattttcagaatggcttagtaaggagcttggaaaatattttccctccaaaaaacaacagtaaaaccagggaacatgatcaagcacaacattagaaatgttatcaaatgcatccaacaaattgagaagcagttattcaagaaaaaccatgaagtcttgattagaacagtgggagtctggcaaacatcacagctgatctgaggtttctctacaggttggggaaagcaacagactagcagactattcagaaatttaacaaggacatctggggaacaagacaggcatagcgggctttcacatatccctggtggtctgtaaatctgtgtgcttgcacaaggtagcacacttgctcaggggagacagagagggctctagcatctactgattccatgctgaacatgaggtcttgcacacaaagaaaacaaaagcttgggcagttttgtaaaccacctgaactttgaacacatttaccaaaccacacacgaagtaatcggcaaatggtggaagtcctagcggctaaaaacgcttaagcacaacttctgattaatcataggctgaccattaagctatgctgactcggtggtaacctccagaaagccaggcttaagaatacaattttttaaaaaaaaatgagcggacatcagtagctacatactgcagacaagatagcctctacaaaatgagtctaagcaagccactaaatgaacaaacagaaatgataaccactggggacagaaatcagaatccagagtttgtacaatatattatctaaaatatccaattttcaaccaaatgtgagatttacaaagaaataggaaagtgcagccaggcgcggtggctcacgcctgtaatcccagcactttgggaggctgaggtgggcggatcacccggggtcaggagtttgagaccagcctggccaacatggtgaaaccccctctctactaaaaatacagacattagctgagtgtggtggcgggtgcctgtagccccagctactaaggaggctgaggcaggagaatcgcttgaacccaggaggcagaagttgcagtgagccgagatcgcgccattgcactccagtctgggcgagaagagccagactctatctcaaaaaaaaaaaaagaaagaaatagtaaagtgctaactgtacacagggaaaaagcagtaatagaatctttcttgggaggacccagatgttgacttaggagacagatttcaaagcagcttttaaaaatatgttttaaaaactagtagaaactacttttaaagaattaaagtatgatgacaatgtttcatcaaatagagaatatcaataaagaagtagaaattataaggaaatataaattttatatatattattatataattgaacaatgaaaacacttggacacaggaaggggaacatcacacaccggggcctgtcgtggggtggggggaggggggagggatagcattaggagatatacctaatgtaaatgacaagttaatgggtgcagcacaccaacacggcacatgtatacatatgtaacaaacccgcacgttgtgcacatgtaccctagaacttaaagtataaaaaaaaagaagtagaaattataaggaaatagaaattttatatatattattatatataaatatataaatatatacataatttatttagatataaaatttctacttctttataatttcttaagaaattatagaaattatatataattgtaaagaaattataaagaagtgaagaaattaaaaagaagaaattttatatataaaatgtctactgttttataatttatatacataattatattttatacataaaatttctacttctttataatgtataattatgctttttatatatataaaatttctacttcttaataaacattgtggggattttcagaatggctgagtgaggagcatggaaaatattatcctacccaaaaacaatattaaagaattaaagaaaagtatgatgacatagtgtatagttagcactctcctatttctttgtaaatctcatattttggttgaaaatgggatattttagataatatattgtacaaactctagattctgatttctgtccccagtggttgttatcatttctgtttgtccttttagtggctatgatggttaatactgagtggcaacttgattggattgaagaaagcaaagtattgatcctgggcgtgtctgtgagggtgttgccaaaggagataaacatttgagtcagtgggctggggaaggcagacccacccttaatctggtgggcacactctaatcagctgccagtgaatataaagcaggtcgaaaaatgtgaaaggcgagactggcctagcctcccagcctacatctttctcccatgctggatgcttcctgcccttgaacatcagattctaatttcttcagttttgaggctcagactgcctctccttgctcctcaagcttgcagagagcctattgtgggaacttgtgattgtgtaaattaataataaactcccccccatatataataatctgtataatattacatatatattagttctgtccctctagagaaccctgactaatatagtggcttacttggactcattttgcagagtctatatatatgtcataatactttaattctttaaacatagtttctactattttaaacgtatttgaaccctagaaatttaaacatttttaaattgaagccaaggtttctaggagttgccactgagtcagcatagcttaatgatcagcctatgattaattggaagttgtgcttaattatatatataacgagctagtgttgaaaagtataatatttggaatgaaatttcaccagaggggctcatgaatagatttgagatggcaggagaaagaatcagtgaactcaaagatagatcgttaaagagtatgcaacttgggcgggcatggtggctcacgcctgtaatcctagcactttgggaggccgaggtgggtggatcacctgaggtcaggagtttgagaccagcctggccaatatggcgaaaccccatctttactaaaaatacaaaaattagctgggcatagtggtgggcacctataaccccagctacttgggaggaatagcaaaactgcagatgtaaatgcatccatagcaataattccataaattaatgaaatcaaatgtcagagctaggcctctgtggttctcagaatcctaagatggtccccaatattcctgttcctggtatacacttattgtagagtttcctcctcttgactgtaggcagaacctgtgaacatgatgggaagttactcccataattaggttactctgtatggcaaaggtgaaggaattctgccactataattaagatttctaatcaattgactttgggctaataaaagggaagatcatcctgggcaggcctggcccagtcaggtgagtccttaaaaaagagtgtctcgtgttgaagaagtaagctaccatttgtgagagggcctatggagggagccacatggctagagcccctgttggggatggcctctaagagctgagggcagtccctggtagacagctagtaagaaaacagggctatcagtcctgcaactgccaggaagtaaattgtgccaacaactggtgagcacagaagaagatttcaagcctcagctgagatcacagctccagccaatgctttgacttcagcctggtgagaccctgagcagagacccaggttgatggactggatgttgtgtttgtgtccccctggaaattcatatgttgaaaccctaatcccaatgtgatggtataagaaggtgggattgttggaaggtaattggtcatgagggtagagccttcatgaatgggatttgtgcccttataaaagaaaccccagaaaactctcttaccttctttctgccatgtgagaatatactgagaaggcagcaagtctgtaacctggaagagggtcctccccagaagctgaccatgctggcaccctgtggtcaggcttcccagcctccagaactgtaagcaggaaatttctgttgtttaaggcctcaaatctatggtaatttgttatagcaacctgatctgactgagatactcagctaacctatacccagagtcttggccacagaaactgtgagataataaatgggtgttttttaaaaaattattattatcatactttaagttttagggtacatgtgcacaacatgcaggttagttacatatgtatacatgtgccatgttggtgtgctgcacccattaactcgtcatttagcattaggtatatctggaattgaacaaagagaacagatggacacaggaatgggtgttgttttgacctgctaagtttgtggtcatttgttatgcagcaatagaaaacaatacagccttgaactctggtctttcttgtagttaattcataccctgaactactctgctctataccaccattcagaaattggctgttcatgtaccacaaaggcctagtagacattttttgtttagcctgcaaagtatgttaaaacatttttaaaaaattagctgtcttgggaggccaaggtgggaggattgcatgagcttaggagttcaagaccagcatgggcaatatagtgagaaccagctcatacaaaaaaccaaaaaaattaaataaaaaataactgcctatatctaaatatcagaggatttcatatgcatgtcgaaattcatggcttcccttgaaaaactggcagacgtggcatcattggcccatattaccacctaggaagaactggctggaggtgaaaagtccctgccttgttgagacagggcctgagccctgtagttcagcacaagccagctccacatgtgacccacatggctgcagttaggcatttgagtatgtaagtcctgatatctaacttcaaagttgatcactgcttgcctcagttttgtttctagttcggtcactgtttcctttcgctctcttcctgacacaatgctacaagaatttagatcataaatcctttgggaatgagtgcccagatcagagctggatattaatctgagaagagaaaatgaactttggtactatggattcaattaagttgagtctgggaaactcttcctttcactaaatttcttattagtgtaggatttcagtttgacaaaaatcctgcattcttttgtcctttgaggaatagatggtgaaacgagcagcatgttttgttttgtttttctttactaccatggaacatgaggggaaaatgccgtgaagcctcaaaaggaaggctccattgaggtcgtgtggtacaaaggatgaatggttaagtttttaaaattgatgcaaattaacataaaatataaaacaatttttggaaaatgatataaatgatgccaattgcgtccactcatgtaaaagaaaaaatttttcttttactcacaacacttctgatgctgaatatgtgggaattttccccacaccaaccaattcttcaactttctgcacaccaactgggtatcctacaattcatttctgacactaattatcccctgtgagctcagactccacaggttaaggactcaatcccacaagactgccctcacattaggtgccagttacaagtaccaggttgtcacctgtacttttgacctataaatcaggggtttccacaagccactcctcatgtttgataatttgctagaatggctcacaaaattcagggaagcatttacttacatttatcagtttatcctaggatattacaaaggatacagatagtagccagatgaagagatacagaggacaaggtccagaaggatgcttagtgcagaagcttctgtctccatgcagttagagtccaccactcttctggcaagtggatgtgttcatcaattcagaacctgtctgaacctcattgtttaaagtttttatggaggcttcattaccatgtagtcatgattaattaaatcattggccactggcaattaagtcaatccccattccctcttccctccccagaggttggggatggggctgaaagttcccaccctctgatcatatgactggttcctgtggcatccagcccccatcctcccaagagtcacctcactagcataaactcaggtatggctgaaatgagcttattgtgaataaaaaaaaaaaagatgctcttctcactccaatcactcaggaaattccaagggttttagaaactctgtgccaagaaccaaggataaagaaccaatatatatttacaattctatcacaatgtcagaggccactcccctcgtctttgaatgtggatcccttacaggaaaaccattgtatctctcagagaatttgtaacctcctaacgggttatccttgcccactgcccagatagagccaatttatcaagagggggaattgcaatagagaaagaacttaatttatacagaacttgttaaacaggagaccagagatatgttactcaaatcagtctctgaaaatctggggactagggtttttcaagggtagtttgtgggaaggaggaatggcttgggaataagtgctgctgattggttgtggatgtaatcatgaagatgtggaaaatggttctcaagtgcacactaagtctattgctgggtgtggccacaggaccagttggtggttcagggtggagccatctgcagtcagaaatgcaaaaacctgaaaagacatctcaaaaggccaatcttaggttctacaatagtggtgttgtctacaggagtaattggagaagttgaaaatcttgtggctaatttattagtcctataataccagtcttgtcaccagcaaagaaggaggtttgtttcagcaaaggactgttatcatccttgtttcaaagttaaactgtaaactaagtttctcccacagttagttcagcctatgcccaggactgaacaagggcagcttgtttagaagcaggatggagtcaaagtccgatctctgtcacagtcatacttttcctactgttatcatttttgcaaagacagtttcacatttacattgggggtagcatttatagaacagatatagcactagtatgaacacccatatgactagcccttgaggaagccagttagtgtggggtagggatagatagaaagaaataatttgccctgctttttgttgttattttgttttccttttttcctatgggacatgagggaagaacaccttgtgggccagtagaaaggaaggctccaatgaggttgtgcagtatggacagtgaatggctgttaagtttttaaaattggggcaaattaacatgaaatataaagcatattttggaatatggtataagtaatgccaattgtagcaactcatgttttgtttttatttttcaaatatttctatgcaataatagaaatcacttgtatgaatttagtttacccatgatctctggacctcgctgtaaggaagtctttcagaaaatcaaaaatgtgagcctatatgaaatatttgtgtgtgcatgcacatggcatacctgacttagaaaagaattctatatgtattcagttttagaacttgtctttagttttagagtttgtaaaaggttgaaaatgtttcactgtccatattaaatgttttactatgctaaaaagaacatctaaaaatcaataaggaaaagaccaataacctgttttttgaaagagctgtatatgcaaagcaatccccaaatgcagaaggagctgagaaaccaaaggaggcagacaagtccagctcgtcatcacagggtgattttattggggaatatagtgacagaagcgtggtcttgggtggccagaagacaggtaggtctttgtgccattactccccagacccggggattatataccgtagggaagggtacatgtgcttcagagggaatcggttggagtttggtctaagggcaggattgacagtaagtatgaatttatcaaggttgatttggtctaaaggcaggatttttggtaaggatgtgctctttcatacacaaggaataatagataaactggaaatctcagaggcattcctggaactggggctaatcaaaagtcagcatggcagattggcatccaagatggagttactttagcctgtacacatcctaatcgaaaaatgaacaaaagatatgaatagaaaattcataaaatagaaaataaaaatgatcacaaggaatgtgaaaagttgttgaagctcagtactaatcagtgaaagtcaaatcaaaataactagattttcaatacgtttgctaatatcaagtattggcgagggtaaaggatactctcacacactgatggggagtatgtacatttgagccactctgaagggcaacttggcaggaagtattacattttataagaatgtatttatgcagaggaggcttcaggtcgacctgtggcagtccagcccttgggggttccctcgccttccacctcctgctcatctgcttcactagctatccctatggtgtcggtgtgcaggccgtggcctgctgtggccatagcacttctggctctgctggtctgcctgggggcgctggtcgacacctgccccatcaaacccgaggctcctggcgaagacgagtccctggaggagctgagccactattatgcttccctgtgccactacctcaacgtggtcaccagacagtggtgggagggtgcagacatgtggtgaggacccctgaggtctccttggggatctgctaaccgcacccacctgatttgcatatccacttcctacccgggaaacacggattccccacctggccatcagggtctgggcaggattcaggtggggacttccacccgcatctcggtaccccctccccctgggctggagggctgtgtatggtccttccctggtcccaaaataaagagcaaattccacaggaaaagaaaataatgcatttatgcattacatgtaggaacaatatttaaaataacgaacccattcttctcgcttcctccaaacaccccttctggccacagtgataagttcaggaatatgatctcagccctggcctaagtcattcagcaactaaaagtcacttggccacagtgattgattcaggagtggacgtatgacataaactggtccaattttagcacttttattggaaatgctgggtgggacacagactctctcttctggccatgaagaaggaaacatgtacttgggatctgctaacaactattttaggaccacgaggggataacctgcctgagaatggggccaacactaaggaaacactgacataccaagccttgtctgaagtcagccctgcctctggtcttgtcagtcacatgagccattcaagttcctattttctttaaaccagtttgagtttttctgttacttgcaattggaagtatgttgactgacacaataatccttcaccaatctcagttatcagggcctgtgacagatcctatgaactgactcactcaataccctttccaatccccttattgcatgccttcctgtatttcagagtctggaaagctgaaaactctatttctcacaattccttgcagctgggattctggatgtgacttaagttctactaatcagaactagctcaagacttgaatttggatatgagttaagcagagagaaacaatactcaaggccaaacatttactggtgcagatcatagcaaagattgtgcagtctgggaatcagctgctattgatggtggctttccagcttcctgatcatagcaggagtagcagctacctaaggtagttcagttctgtggtatggatttggaagcactcctggaagctctacctagatcctttttcttcatccctacccacgattctgtaagccagttaaatactataaattactttctgctgacattagctagaaaagattctgctctttgaaaataaacccagatcatacagtattctttgagcctttgacactactacactcagggctgtgggagccagtcaaaattttttctctttttaaagacagggtctcactctgttgcccaggttggagtgcagtggtgtgatcacagctcactgcagcctcgacctgccaggctcaattgatcctcctgcctcagcctctcaagtagctgggactacaggcatgcaccacgacacctggctatttttgtattttttgtagagatagggtttcactgtgtttcccaggctggtcttggagcaatcctcctgccttggcctcccaaagtgctgggattacaggcgtgactcactgcttggccaagagccagtctatgtagcaaaaataaaccagagctaaataaaagcatactcgtttctagacatttgcaattatctctatcctcaccacttaaaactaggatttttaaaaatgtcctgtctatacaagtcctaagctggtctggtgacccaagaatagcctctgtacagttctagtgtcaccctgcttttgcttgtacttttccctcaacctctaccttcaatggtataacaggcttttctgtggaaggtcatccattattattaccagcaaagagaattatggcggtaagaggacccagtaagatgcctctggaatgcgaatgttcccaggcattgtccagactctcaaatttcagctatgtttaactagaaaagatgatgccaaacaacaattatcaggaacaatcaaatgcagacagtttagtaaataactcgcctagaccaattttccctgccagaaattcagcatttgattatgctttcaatttagatttttgcctctttgtactccaggggtaggtcagggcatgcagtggacagtcaataaatacatcctaaagaaatgaattttgtaccagctctacattctaggataacaggtctgctcagaaaacaaatggtgtcagttggacccattctgttgggctaccctaacagaataccacagactaggtggcttaaacaacagaaatttattttctcaggatttagccaacataaccaggcttaaaatgcagttgtaagaaggaagtcgtgagggagtgctgactttgatagatagccccaataaaagcccatcattcattcaacaaatgtttaccaagtcccaaccacaaagtgctgatggtgcagaaaggaacaaggtacaatttttctcacaaaaagttgtctgatgttgggagacacacaataaacatctaattccaattcattgtgttcagcactaggtcacagttcagtggcaaggaaccactaactctacctggaagagtcataaaaaagaagaggacacatgggcctggcaccagaaggactgccaatgttgcatctggtaactcaatgtgtcatttacctagggcagtactgggttgcctaaatagtcagatgcctagggcattagcaaagctggggtaaaacaaaaatgtaaatcaactttacattatatataaaacaagagaaaataagaagttggttaaattttgttccatctattttatggtgcaatatcattttattctgaattacatatggggtaggaagaggtgggcataactttttctaaagtatatgtattctggccaggtgtggtggctcatgtccgtaattccagccctttgggagactgaggcaggaggctcacttgagcccaggagttacttgagcctgggcaacatggtgagaccccatgtctacaaaagatttttaaaaaatgtttaaaaagtatccatattctgaaaaacaatacacatacacaaaattgcataaagtataaatgtacaactaaaagttgttataaagtaaacactatgtaaccatcacccaggcaagaaatagaacattgtctgcagcatcccaggagcaccactgcagacggccaggtgtcttggtttgccttggactgttccacttttagcacagaaaggctcaaatcccaaggaaactcctccctgggatgtgaaaagtctcaattttctgtgatgggtacagaagattgggggaaaagcacaaaacccatatggtgacccgccccccccgcccaaatagggagtgaaaacagcagtttgtaatgtgaaatggatatggcatagattctctgccttctgtagttgctgtggccattttttttgccccaactgctgatattgacaaccatgatttgcagctcacaataatgatcatccattgttgcatcacggtgactgatgccactttagcatgcaacttaagtgcattgaaattgtgagcattaacaagctcgcctttgtatttgcctgtggatcaactgttgtaatttgtatcaaggttgtttaacctttcacatcatgaatattgtgaccatgtgcattagtttgctagggctaccataacagaataccacagactaggtggcttaaacaacagaaatgtattttctcacagttctggaagctgacaatccaagaccaaggtgccagcaggtttggttttttctgaggcttctctccttggcttgcagatggcaaccttccttctgtgtcctcacaggtctttcctttgtgcttgtgaatccctggtgtctctgtgtgtggaaatttcctctttgtataaggacactggacagattaaattagggcccaccctaatagccacattttaacgtaatcacctctttaaaggccctatttccgaatactgtcacattctgagatacttggggctaaggtttcagcatatgactttttgggggacacaattcaaccataacaccatgttttgtaagaatgcagataacaggtgggaaaattgcttgagcccaggagttcgagaccgagagttcgagttcgagatcagcctacccaacatagtgagacactgtctcaacaaaaaatagaaaaattaaccaggcgtggtggcgcatgcctgtagtcccagctacagaggtgaaaggggaaggatcaattgagcctggaaggtagaagctgcagtaagccgagaatgctccactgcacccccagcctgggtgacagggtgagaccctatctcaaaaaaaaaaatgaagtttcatattatcttcttgatttcaatgaagatattaataaaaccacagaaaatatgaaaaaatacaaacgagacttttctcatttatctgtatgtttagcagacagcataaatgtcaattgtgtggaattccattcagtctataaactttttattgaaataaatgaaaagaccttacctgctaaatgtcatgcacaccttgtacacaatcctgctaaagacagatacattctgcttatctataaaattaaaggttttataatgaaagtttttgatgactttttaatttcttcaaaatatgcagaagtatgtagtgagtttttttttactttatagaaatgggaggagatagcctccttaacaggtgcctacaatatctatcattgttgccagccataggaaaaaaaatgttaaaatgtcagcctgccataaaaccataatttcaaagtgcggtatgagaagaatgtccttctgtaatttggaaatacattgagaataaaaatggagaaaaggatgacaataaaacagaaatttatcagctgttcctctaaaactgtttgaagaccattgaagaggtcatatggagcctcggaaagaatggactcattacagctgagctgttccatgttatgagtagatctcaacaaaaaaccacatggcaaaaaatgactcattcatgcagacatcgtaagactgcttcagaacaacaacaaaaaaagttaccaggaaaaggcaacaacatgaaataagacttcatcaatttctctaataaaactgtaacttatttggaatccaactggattcctatagcaatcaaaaagttcaaattacttctgccccttgggaccattttccctttgaaagagaagtttagcttgtggtaacatctatttattgggagttacgtaaggaaaaactctccacaaactgtgttcttcctctactctcaccaccaccaaaatcatcaacacagaaaacttctgtgaccaaatgtagagggaggtttccccacacaccaacagtggacaccagctgggtatcctctgattctccaaaaagatagtgtcagatcctacaggttgggggatcagtccccaagactgccctccccacaccagttgcaagtctgggcctccagaacttctggcctacctaccggcttcaagttggggttcccatgatcccctctttcatttgattaatttgctggagtggctcataaaacttagggaaacacatttaccggtttattataaaagatattgcaaaggatacagatgaagagagtacagggtgagctatggaggaaagggtgtggagcttccctcccctccctagacatgccaccctccaggaacctccatgtgttcagccctctggaagctcactgaacaccgtcctcttgtgtccggaattggtgggttcttggtctcactgacttcaagaatgaagccgcggaccctcgcggtgagtgttacagctcttaaggtggcacgtctagagtttgttccttctgatgttcggatgcgttcggagtttcttccttctggtgggtttgtggtctcgctggctcaggagtgaagctgcagaccttcgcggtgagtgttacagctcttaaggcagcgcgtctggagttgttcgttcttcccggtgggctcgtggtcttgctggcttcaggagtgaagctgcagactttcgcggtgagtgttacagctcataaaagcagtgtggacccaaagagtgagcagcagcaagatttactgcaaagagcaaaagaacaaagcctctacagtgtggaaggggacctcagcgggttgccactgctggctccggcagcctgcttttattctcttatctggccccacccacatcctgctgattggtagagctgagtggcctgttttgacagggcgctgattggtgcgtttacaatccctgagctagatacaaaggttctccacgtccccatcagattagttagatacagagtttggacacacaggttctccaaggccccaccagagcagctagatacagagtgtcgattggtgcattcacaaaccttgagctaaacacagggtgttgattggtatgtttacaaaccttgagctagatacagagtgccgattggtgtatttacaatccctgagctagacataaaggttctccaaggccccaccagagcagctagatacagagtgtcgattggtgcactcacaaaccttgagctaaacacagggtgctgattggtgtgtttacaaaccttgagctagatacagagtgccgattggtgtattcacaaaccttgagctaaacacagggtgttgattggtgtgtttaccatccctgagctagacataaaggttctccaaggccccaccagagcagctagatacagagtgtcaattggtgcactcacaaaccttgagctaaacacagggtgctgattggtgtgtttacaaaccttgagctagatacagagtgccaattggtgtatttacaatccctgagctagacataaaggtcctccaaggccccaccagactcaggagcccagctggcttcacccagtggatcctgcaccggggctgcaggtggagctgcctgccagtcccggtgccgtgcgcacactcctcagcccttgggtggtcaatgggactgggcgcagtggagcagggggcagtgctcgtcggggaggctcgggctgcacaggaacccacggagtgggtgggaggctcagccatggcgggctgcaggtcccaagccctgccgcgcgggaaggcagctaaggcccggcgagaaatcgagcacagcgccggtgggccggcactgctgggggacccagtacaccctccgcagccgctggcccgggtgctaagtccctcattgcccggggccagcaggctggccggctgctctgagggccgggcccgccaagcccacgcccacccggaactccagctggccagcaagcgccgcacgcagcgccggttcccgctcgcgcctctccctccacacctccctgcaagctgagggagtgggctccagccttggccagcccagaaaggggctcccacagtgcagtggtgggctgaagggccctcaaatgctgccaaagtgggagcccaggcagaggaggtgccgagagcaagcgagggctctgaggactgccagcacgctgtcacctctcactcttgggtttttatggaaacttcatgacattagcatttcttctcccaaggtgtagggtaggacgttctcatgggaggtcttaagacccacagtcagaaaggtgggggaacattagagtaaaaagaggacaggaggtcagaggcctgctactaaagcctaacacacccaatattttcacaaaagactgtaacaagggctatgggagttacgagccaggaaccgtggacaaaaaccaatatatatcataacaccacgagagcatttaaaaatggtaagcatattaaaacatggatagcttcatgtatatgatgtatttatagatgtaacaggcccgactgacaaacagctgacctaccaaaacaatcctgtagacagaaagtggtgggacatttctataaatctaaaaacctgctgctgctagtaagtaaaattctaagtattcaatgctcacatttttgttgttgttgttgtcgaaaggctatgcagcctggcaaacaccaaaaatcagtgcagaactgcaggtcaaaatgacttttatatttgattgtatgaaattttactactatatgaaagaaaaaaaatttttaatgtcctgatggtcacaggcagttctgaattaattattatcagaaaaaaaccagaaagaataaatatatcctactatatcatggaccaaaagaaacatgtcattactattttgaaacatcaaatataggcaatatctgttcaattagtcctcttgcatttatattttcctttttaataagtcttatatttaagtacctgaagaatacagaatattataggctacaaaatttaaatatctagtaagaagctaaaaaaagagttaagtagctgtatcagacagaaacattataaaaacattggtatatttttgttccccatattattggtttaattagtcttactattaattactactaattgccactgttaactagtcctactagtgtttcatttaaataacagaattgatacacagaaaagaaaataataaataatgtataattctaaataaacacctattttaatatttttatgttaaggttataacacatgtataattatttattacgtattatatcattatggttttcttttgtctgatgtgactgtgtcctagtttgctttgtaaaaagttggtcatccaaaccacaccacaaccaccactaactactcccactataatattaatatatagtcttaacccatttatgccttaggttacaattttttgaatttttgcaatcggaccttggcgatgacattgatataaataactccccatgcttagcgttccaataatggaatactaggcataaataggcttaatttagctttggtttagggtgtaatagtgaagggtgaaatgcacattgaaatttgtctggcttgtcatctcaggaggcatgtctattcctctctctagggaatgtcctaattgtgagggaaaaaccaaaagctgggaatcaatacatgtagccttgagttccgctattccccatttgagctatctctgaacttttgtgggccccattcctgtactagtcaaaggcagattcctacttccctctgacagtggtaagggctcagaaatgtttgggaatatagggatggggccactaccccttgctgtttatctctttctcctcaaataatatttcttctgctttgaggatcactagaattttttatacaagtctggagtgcggtgagagatttttactccttggaaatcaaagttctcatcgtataaagggccataagtttgtgtaggtttgcctgcaaggggcagtagggacaagggagctggagtaggtgattaacaaggttctagtttcttcctgcagaggactcaggttagctaacaagagagtagcttcgtttcctggattctgtctatgggaaggaaatacactccaacttcggaggaaattcacaaccctttagaaccaggagccaaaaacacagctgcgcatctaaccaggaagcccttccttgctgccagtgcttccctcctcgatgttgtactttgactccatagaaaggtgaaaatgaataccttggatgccctcctgcccaagtattgttcttccctcagccctctgtggcagactgtgaagtggaaagggcactagcagggaagccaggaggctgagcttttccttccaacactcccccacttaccgctgccctacctttctgcctgctttgctaagaggtagatctgcaaaacggggcgatgatgcagacctcaccaagatgttgagaggattccctgctagtttatgaagcatccacacaccagatgctcaatgcctgtcggctgtatgggactcaaccattgccaggaccaggccttcgaatgccaagacctttgccctcctttccatccacaatgaaaataccagttgacacgtaccactttatatatattaacacattttaaccttctcaatagtcttatgaattgggaaatattgtccccatttacagggaacccatttctacactagtcaaaggcagattcctacttccctatgagaatggtaagggctcagaaatgtttgggaatatagggatggggccactctcctttgctcttgatctcttcctccttaaataatatttcttctgctttgggaatcactagatttttattcaacaagtcagaagtggagtgagagatttttactccttggaaatcaaagttgagacagagagttgaagtaaccttcctacagtcgaacagctagtaagtgatggagttgctatgtgaacccaggtggtctggctgaagtgtttgttctctgggatgctgaatgcatcctcagctcttgcccatatgtgcagagtttaatcccaggatgtggcagtatgtaatgtccccacctgcagggtggaagcatacagactgcccagaggccacactttgctgcactggtcctttctgggccaaacaaacaaccgtagtcccattcccaccacaagccatccactaggttacactttagcccattttgagaccctggcctgcctgaatttgcatttgggccataaggagggaaactcagaaacccagatccttctggagaaaagtgtggaggaagtgaggttatggctggggctaatgagacccacaagaatgagaagattaacccctgtcagtgccagaccctccctgaagcaccaggggtccatcctccagggttccagctctcctcagcaggaaatgggcactgaaacagacaaagaggcaggtggtgcaggtgacctgcagcacccaaatagctttggttgaagtggtgaacgctgaggagttgctcgacttagctctccctcccccagaaggccccctagctgcctcttcctggcccttgccagtatccagcccgcaggcagataagtctttgctgtgggacccgtaataccactgacagcttggcctgagctgaggattggggtgggggtaggagtgaggggtgagagaatgaatggagttccggggccctcctcgaaaccctcaaatcgaaccctggtttagcagagtgtttgtcctctctcttggcttacacactcttctacccacacggaagttggcatggaaaatttgtctaggagaagataaatctggagggtggaggagggagggcattggcacgattgttccaagatgaggagctgagactactgagcactactaagagtgaggttttcctcatacagagcaccacttaataaagtctggacatggctaaatgatttttttttttttttagatggagtctcgctctgtcatcaggctggagtgcagtggcatgatctacgctcactgcaatctctgactgcctgattcaagtgattctcctgcctcagcctcctgagtagctgggactacaggcacgcgccaccacgcccagctaatttctgtatttttagtagagacggggtttcaccatgttggtcaggatggtctcgatttcctgacctcgtgatctgcccgcctcagcctcccaaagtgctgggattacaggcgtgagcaaccgcgcccggcaggtcaagtgatttttaactacgtacagtagcattgctagccagctagttagatatagcctccccttggcctgggaaccccttaatgggctgccagacttcttaaaaatcctttccccacatctcctgctctctgtgtttgaggctgtttcctctctacactatcatcttgaaagcaaggtaggttttgtaaggtttaccaccagacatggatctcagccaagtgatggaaaaaagaataagggacttgtgcctagaatacacaaggggctcttacaactcaataataaaataacaaataacccagttcaaaaacaggcaaagaatctgaatggacagttctccaaatgagatgcaagaatggtgaataagcacatgaaaacatgctcagacatcatgagtcatcaaggatgctgcaaatcaaaatcacaaagacgtaccactgcataccgcctgggatggctagaatcaaggcagataacaagtatcggtgaagatgtggagaaatgggagccctcataacctgttgatgcaaacacaaaatggtccagcttctttagaaaacagtctggtggttcccccaaaattaaatatacggttactgtatgactcagcaattctactcctagatatatacccaagaatattgaaaacataagcccgtgcagacatttgttcatgaatatatatagcagcattagtcacaatagtgaaaaggtggaaatgaaccaaacgttcatcgacagaagaatggataaacaaaatgtgatatacccatacaatggaatattatccagctatcaaaggaataaagcactgatacatacactctcaaatggatgaaccttgaacacatactaagtgaaaaaagccagtcacaaaagaccacacactatatgattctattcatatgaaagcctagaatagggaaatgtatagagacagagagtagattagtgattacttagggcttggggaagggggtggatgggtagggaaatgacggctaaatggtttctttttgaggtaatgaaaatgttctaaaattgtggcaattgttatgcacatatgtgaatacaccaaaaccactgaactgtacacttttaatgagcaaattgtatgctgtgtgaattatgtctcaataaagctatacttaatttaaaaatcaagtataaaacgatggggaaatacttaaattaatttattccaagtgtatatgagcaacagaaagtcttttgtcacctcctacacacttcctaaccacacacacacacacacacacacacacacacacacacactgtccttccaactcacccatggcaacagcatatatagtgggtgcttaagaaatatttgttacattggtgaatatattttatatctaagaatggatatagagggggtgggccaacagagtaataaaataactgaaagttgtctgctgaggggaacagtggacagctagatgggcgtgggctgtggttgggggtggtcactacaggtcctctctctgcatgcattttgtcagcctggcagagaactgcttccctgaaatcctgggaaacacaccagttttcagttgtacctctctagattcagttgctgcttcctctttagtcaaatcccttttcttgtcagctgctccatcacagtctgctcccccaaggccaccatctcccttgccctctcccaatcctactacctggatgcccgcagttccactaggaattgagcagaccctacagcaaaaaagctgccttgtgagctaatcagcttcatgtcaccagaggtgtgaaggaggacgatggaagtctacttattgagaattttggagagacgattcctgtataagattccatcacatcctgtataagcatgcttgactcatttaacattaccaatttcaacttccttatctgtaaagtgggtgcatgcatgcacatcctccccaaactgtctaccagaaggtaattcagatagtttctgctttaaacaaacccacaaataaggaattgtggatttgcaagtcgataacctttcaaaagtgcagaaaggacaaaaaggaagaaataacatagtattggattataacccaaagtatgaaatacatgagtccatgatgatataaataaatgcttgaacaaataaataaatgggggagaaagggcaaattttccttatagaatgattccaaataatatatgtagataatcccttcctccaagaggtgcagcttgatacccttctgcttgagtgtgggctggacttaatagctcacttcaaactaatgcatccataaagtagaaatatatatagaaatggaaacatagtaactttatggtagagaaaccctacaaacactaccttggccaggtgatcaaggttaacttactagtgataagtcatgtggatattatgtacccactgacacgattcgatgagaagggcatttcacctctgtggtattctgccctcaaacccataacactggtctaattatgaggaaaacatcggacaaaccaaaattgagggacgttccccaaaatacctggccaatatgtttaaaaactgtgaaggtcgtgagtaccaaggaaaaactgacaaactaacagaccagaggagagtaagaagacagtgactaaatgaaatgtggtatcctggattgaattctcgagcagaaaaaggacattagtggcaaaacaagtaaaatatgaataaagtctgtagttagttaaagtaatccacaaatgctgatctctaaattttgacgaaaggaccatggttatgtaacaggttaagaaagcagaaactgggtgatgggtatacgtgaatactcagtactgtctttgcaacttcgatgtaaatctaaaattatttcaaaacaagaagtttatttaaagaaacaaaccctggtcagtaagttgatgaaaaaaagaaggagaagaaggaagacagaaaagaaaaggaatagtctcaagattcctttaacaggatttaaaggccttaatacaaccattcatcaaaggtatttgtagagacaggcactatggtataacagttaagaattgactgttataccgctctaccgcttgctacctgtgtgaccacgagtaagtaacttaaccccccgtgcctcagtttacccatctctaaaatgaggataataatagcaactacctcatggcccaatacaaggttcaatttttttttttttttttttttttttggctagtcaagtgaagcagtgggagtacagaagcaacaaagaaatctatcactggttgtggtcattagctgtaaacaccactgcacttggagcagcctgatttttttttttaattttttttttttttttttttgaggcaaggtctttctttgtcatccaggctggagtacaatggcgtgaccacagctcactgtagcctggaacacctgggctcaagcaatcctcccactccagcttcctgagtaactgggaccacaggaagccgccaccatgcctggctaatttgttttatttgttgtagagatgaagtctcacaatattacccaggttggtctgaaagtcttggcctcaagtgatccaaccacctcagcctcccaagtagctggacatacaggtgtgcgccaccacacctgtctaatttttgtattttctgcagagaagagggctcactatgttgcccaggctggtctcaaactcctggcctcaagtgatcctcccacctcagcctctgaaagtactgggattacaggcgtgagccactatgcttggccaagattgatatttgttaatgagttaatataatacagtacttaaaacaatgcctagcactagtaaatgccatgtttttgtatttttatattatagataaatatataattgtttgttaaataaaatatcaagtcatactgctacaaacactcctggataggcactgcctgtgcagcagcccatcatatacctcagtacacatccactggactcatacaacagatccagaatacaatttagggctacttatgaaactagcgacctgtgagctagcctgtagaatccccaagtggtgattagaggagctacttttgaataacaggctgccttggggaccccaggcatagatcagcagttaattgtagatgatgatatatcagagagaaacctaccagacaccattgtgtccaaggaagtatttctattccttcctccacatatttgcttgagttgcttttgtcctctaatactctccttatttacccgatgatgaattaagatcttcccttcctttaacacccaacttagatcccacctcagctctgaggcctcatgggcctatcccagtctttcctctgaactccaacagtacttggtcccttcatgtggcccttagaatacactgccttgtgcatttctcttctctcctcaattaatcataagtacctcatgggcaggcactgctcttgtgtccctcgcaggaatgagctcaccttccactgcccctgtgagaggggaaccaactaagagtatgcaagggaaaacagaaagtccactcttccaatcattcgtcaaatactgactgagccctgtgcttgggctgtgggatgtggagggtgaaagagttgagtccttttcctcaggaagcccacaatcttgaatcaaatcgttacatcccaaatgcataataatatttgcctctggtgggggtagggaaaatgggacaggggaaagaagcaaatgaggctgtgttcgttttagcataattatctagagaaaagaaaaagactctccagaggctgtaaaactaaaggcgggggtcaggggcaattctgatgagagagagagagaagaatttggagcttggggcggccagagcatatagctcaggagagaaacagtaagagagagaggagaaagtatgacccttccttcagtctctccatcttcaacaaattctactccccaccaccaattattattattattttgagacaggactcactctgtctcccacactagagtgcagtggcaggatcatggctcactgcagccttgacctcctaggctcaagcgatcctcccacctcagcctcctgaatagctgggaccacagctgcataccaccatgcctggctaattcttaaaacaaatttttgtagagacagcatcaccttatgttgcccaggctggtgttgaactgctggccttaagcaatctcccaccttggcctctcaatgtgcagggtttacatgagtgagccactgtgcctggcccagttactttaaaaaacaacaacaacaacaaaaaacaaacaaacaaacaaaaacctttgatgccatttgattgtggtaattgctaggaagaaaacacagagagaaagtaacagggtagagggtatattttagacttggcatgcagagaaggcctctttggggagaggatatttaaattgagacctaaagacaaagttgctagaagtgcaaagactgggaataggagttggggtgagtgtttcagatgaggggaacaatgaaatagagaaatattgttttcgagaaaagaagaaagcgtgagtggaaataagcagtaggagatattacgtccactgagatttgggttaagtgacttgccccagattacgcagctagtcagtgacaaatgagagaattcatgagctctattttgagaaatagaattgaacagaaggcccctggaacttcaagatagcatctagcaagagcagcacggacaaaacaatagggacagagactcaggcagctttcttgctttcttttaaaaaaaacatgtgtctattttccccttttgtttgcatccaaacatccattatctgtgcctatttttattgaatatatttaaggtgtacgatgtgatgttgagactttctattattctggaaattttgtcaaaattccagtgttattgatttttgtgaatccttctgtgttttcctgaaggggctgacagcaaaatccttgaatgaaaagtactggatttgtcagaatttcccacgtgctaggccatagctgcttgtctttggggaaagcaaggaaggggtgaccttcaggcctggatcccacacttcagtcagtcttgggaaaggtgaagcctgaggctctttgaaggagaaaaaagaagctgaatgaggctggacatggtggctcatgcctgtaatcccagcactttgggaggccaaggcaggcggctcacgaggtcaggagatcaagaccatcctgtctaacacagtgaaaccccatctctactaaaaatacaaaaaattagccaggcgtggtggcactcgcttctagtgccagctactcaggaggctgaggtaggagaatcacttgaatccaggaggtggaggttgcagtgagccaagatcacgccactgtgctccagccttggtgacagagcaagactgtctcaaaaaaaaaaaaaacaaaaaggctaaatgaagacctgggtttggggaagaatccaaaacaggaggggctacatgattggagacatggtgggggattgaagggatgatgggaacttcacagtttagaagagggccatatgggtcccctggaaaatggctcagacagagcagtcatcttgctcaaggtcgcagagctagtgtgtggcaaaaccaggagtggagcccatgtttgacgggttccacagcctttctattatatcacccaagatgattttccccacaactcctgtttaatgttgccattatgttggttttagaatgttttttagaacatatgagtgtgtgtgagagcgtgtgagcgtgtgttgaggagaggccttgttagcatggaagcacttttgctcttgtatgtgcatatttctcccatgtttacctaagacttggtgggattatcaggtgaatgtatttctttctgttgagaaatctaactccagagaacacagggaaatcctgaaacctgaagagaggggtctgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgcagattctggatattagccctttgtcagatgagtaggttgcgaaaattttctcccattttgtaggctacctgttcactctgatggtagtttcttttgctgtgcagaagctctttagtttaattagatcccatttgtcaattttgtcttttgttgccattgcttttggtgtttcagacatgaagtccttgcccatgcctgtgtcctgaatggtaatgcctaggttttcttctagggtttttatggttttaggttgaacgtttaagtctttaagccatcttgaattgatttttgtataaggtgtgaggaagggatccagttttagctttctacatatggctagccagttttcccagcaccatttattaaatagggaatcctttccccattgcttgtttttctcaggtttgttagaatggcaatcattaaaaagtcaggaaacaacaggtgctggagaggatgtggagaaataggaacacttttacactgttggtgggactgtaaactagttcaaccattgtggaagtcagtgtggcgactcctcagggatctagaactggaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagaccggattaagaaaatgtggcacatatacaccatggaatactatgcagccataaaaaatgatgagttcatgtccttcatagggacatggatgaaattggaaatcatcattctcagtaaactatcgcaagaacaaaaaaccaaacaccgcatattctcactcataggtgggaactgaacaatgagatcacatggacacaggaaggggaatatcacactctggggactgttgtggggtggtgggagcggggagggatagcatcaggagatatacctaatgctagatgacgagttagtgggtgcagcgcaccagcatggcacatgtatacatatgtaactaacctgcacaatgtgcacatgtaccctaaaacttaaaagtataataaaaaaaaaagagaggggtctgaggcacactgacactccccttcttgccagatcctttggattcttgggacagctgagcaagaatggggagaaagcatccaaaagcatccacctggagtgcaggctgagcctctagattgagcttttacaggactagaaacatggaaggaaggtcagacattgacagccagagagacacctgttggctagtgtctaagggagaccagatagtgggatgttgaaagaataaggacagaacaaaggtctgggtagctcaccatcttttcctgagttatcctttcactgtgtgaattttttcttttctttgttttttctttttgagacaggatctcgctctgtcacccagcctggagtgcagtagcatgatagcagctcagtgtagtcttcacttccctggctcagttgatcctcccacctctgcctccagagaagctcagattacaggcatgtgccactacgcctggcaaatttttgtattttttgtagagatgtggtttctctatgttgcccaggctggtcctgaactcctgggctaacaggatcctcctgtcttggcctcccaaagtgctggaattacaggcaggagccccatgcctggtgtgaatggaaagtgctatcaactcccagcttctcaaacacggtatatgtgataagagtatgagctctgaagtctctactaaccttggcaaatcagggaaccgctctgatcctaggttttctcatctgtaaaacagggttaatgatagtacccatcccataggaatgctaatgagattaagtggtatggaaagccacgggaacagaggctaacacacagtaggccaccagtgcatagtatctatccttatttcctcccattgaatgaaaatgcaaatgcaaatgaccattggattatccaggcaactgtatacttctgtaagaccaaataataaaaccactggggtggaaagaatgttacagatctgttgctctctcttagtttgacacatgaggaacccaaaacccaatggagacaagtgcattagaggaaaatgaaaaagactgtgcaaaagcaaacatcacgaaagggaattataagatttttgagtggctgcaagaccagatgagttagtgtgcatatacatgtttcaaagcgagagggaaaaagaggaaactggaggggagataaggctatcaaagaaggaaagaccagcatacaatgtgctttcctgtgaaagtcaggagtttgaacttcacctagatcagcattgtccattaagaatataatgtgatccacataggcaattttaagtattctagccgccacatgaaaaaagaaatgggcaaaatcaactttaacattataattcatttaacccactatatcaaatacattatcattttaacatgcagtcaaaatgaatactgattaatgacattttgcactcttttttgaatactaagtcattgaaatctggcatgtagttttacagtgacagcacatcttaatctgaactagccacatttcaaatgctcaagggccacatgtaactcaagggccacatgaatctaaggactagtgtatttgtcactgcagacctaggcaatggggagccactgaggcgttttaggcagtggagcgccatgtcctgatgcgtgcttcagagcaagaacaggagccagccactcaagattgctatgtgtatttgtgcaagttgtgtgcggtacaaaggacgtggatgtgggctgcaatgcagcccaataattctatacatcaagccaagcaccctggcacaacactgccagctcagagtaaagtgaaccttttcctgattggtcagcccagaggcagtgcctttcagaaacaacaataagaacaacaaaaacacaactttcacgaagatactatatgtactagcactagccttggggaaaagccaggcccatgtagcaggtacacatattagtccaccactcaggtaagaagcagcacatctttttacaaatcatagtgaattccactttgatctcccaggacccacagtctggagggaaactcaacctcaattattcttgggactcttcactcagagttgcgcctgagttctgatttttgtatgtaccaggacataggggtatggccctctctggtcatcaagtcgtctactcacagcggctaatgctgaggtatctactggcctctgtgcaggacccttcaggcccaacagcactctgatgattctgcaaaaatcctctgcttaacatcccaccctcctagattccccacctcaccattcctttctggggtcttgctgccttcccatgcacactgcccagaagccagcccaggctctcctgctctggaactttctcttctcccattgtatcagggaaatcactttttttgatgtggaaaaaagtcgttttcccttcatgtctcctccaagatggtttttgttttgtttctttactggcaaactttccccactttgaggctcaaggctgttgtgaaccaaaattagaaagtgctataggggcgccaggcctggtggcttacccctgtaatcccagcacttcgggaggccgaggcaggtgggtggccaggagttccagaccagcctgagtgacatggtgaaaccccatcactatttttttttagtgctgtacgaaaagtcacttttctgccctgttttctgccgtgctacaaacctcctggtagccaagagggcctgaaccagctatctgcttgatggaaggaaagaaaaggaggaatgcacaggaagaaaaaaataaataaatatattagtctcctaaaatattatccagctatagagcaacagaaagtctcctataccactgatggaagagtaaatttgtacaaccaccgtgacagggtttgtcacgatctattaaagttgaatatagtcatatcaggaatatcacctgtaggtatgtatccaataaaatgagtgcttgtggctagcaaaagacatgtataggtgcattcatagcagcactattcctaataggatcaaactggaaacaacccaaataaatgtccatcaactatacaatggacgatatataatggaatattatacaatatgagaataaaacaacaagcaacaacacggctgactctcacaagcataatgttgagcaaaggaaactaaacgcacaaaaaatcatacggtgtgattctatttagctatgaagtgttgtaaaaggcagaatccagcctggtcaacatagtgaagccccatctctacaaaaaatgcaaatattagcctggtgtggtggcacatgcctgtggttccagttacttgggatgctgaggtggaaggagcccacctcacatgagccttggaggtcgaggctgcagtgagctgtgattgcaccacggccttccagcctgagcaacagacagactctgtctaaaaaaaaaaaaaaaaaaaaaaaggcagactaagaggggcttttgagtgcttcgaatgttctgtttcttgaccatgggtgggctcagtttgtgataatttattgataatgtgttgagcttataattttgttcagttttctgtatatagccaatacaatgtttaaaaagtaggatgtcaacaaaagaaaaacaattacctagtcacaccaattaactgacaacatgcaataatccaggcaagaaagaatgaaggcgtgaataatttaaagtagtggaaataaggagagggaagctaggactggatgtatgattggatgtagacattagacagagagaggagttcttgacaatgcccaggattccagcttggacaactgggtaaatgatgatggtgggactggttgagatatggaacattggaagagataaggctggtgagtagatggtgaatacaattggcacatgatgagttcatagtgtctatggacattcatgtggagaggcacaatggcatggggtttaaaagtgagggctgatttttattctgtacatgatggaataaacacacacctccctttattgcctactgaacttgagtacaaagcttgtacagaatgcatgccaaactatttgagaactctgaaaagtaaatattagcagacagactagagaaggctagaattaacagtgccaccaaactggaagtgagtttactatttttgttcctgcagcatcccccagcaggaactcaagacaatctgaaactcagaagtgagcactctggtacagacagagatccagtagaaaccctctacttctggttggaggggtggaaaggggagatccaaaatgctcaaagagagtggaggaaatacactggtgctgtttttattttttcccctgtggtctgtcaccccagtcagcaggcggtcccacagttgaggtggtggcagtgggaaagagtagccggggatgggaaactgcagaagccaaaagtgaatgaaaagggagaaccttacttttctgttcaatgaagctgcagctttaagggggaggggccaaaacccattgccttttttttttttttttttttttgtctctgtctccccgccccctgctccttccccgccccgagcaaagcgtctcctgccacgtggcccagacaacctccatcaatgagagcctgcagggtactggaaagtattggaaggataacggaaagtgaggagctcaggaatgtggccccaaagagctgttatgacatctagggtttacccttgacctctgcgtccgttttctgaacctaactaccataacgaaggctgtcagaactgagaactgagctaagcggtcttcccaacagacccaactgacctactggttggtcacgcgagaaaacggattagaactgcgaaatatttgaaagcttaactgacattggaaatataggctgtagaagaataaaagaaatagcaacattctccatagtgggggtggggtgatgactcttaaagggagagcagagggagtttattgggcgtgatgaactgttctgtatcctgattatggtggtagctacataatctatacatgtgttaaaatttatagaactgtgaaccaaaacggaagaaagccagttttacagaataatacttaaaaaaatataatttaaaagtgtgaaggctctggtgttcaaattctggtaacaccactcactagctgtgttgaccccaaacaagtttccacccctctgtgcttcagtttccttgccctcaaacagagaaaatcctagtttctgcctcctggagagtttgttatgatggaggttaaatgagataatacatataatgtgcttagacagtgcctgagacatagtgtttgcttaagaaatgtctgtgtatgtccagtagtcagttcaatataagggcctggggttcaggaaactggtgagaggatggaagaaatcactgcgtgagtcactgctgtgtatatttgggtatttatagccataggacaaatagctgctgtgaccttatgtttttaagccatgcaacctacccagccaccaagcttcctcacttcactcctgaccgctttccagttttcatgtagttcctaacctgtggtgctgtctccaatttggccttcagttcactgactggtcatgacctctccaagctgttctttaagctgttctcattcttctttgtggatcaaaacctcttggacattctgcaaaatgcctggcctagactcttaaaaaagtgacaatgtcattaaagaccaggaaaaaatggctgggacctttctagattaaaggagactaaagggacatgataactcaatacaatgcatggatattggatagagcagaggggaacagctattgaggctattattgggattttttaggacaactggctatgacttgtatgtggacgaatgtcctagttcctaggagacacacactggagtatttagggttgaatatcatgatgtctacactgactttcaaatggctcagaaaaataatgataattttatataataataataattattatatatatgcacacaattttagtcatttgtgtgccagatagataaagcaagatggcaaaatatgaacaattgaagctagatgaagggtatatgggtacttattatactggtgttacaacttttccataagttttaatttcttcaaaatagaacggagtaatatgacatcacttggagatatgtaaaatatacatgcttgttttgcaaccccaaacaaaggaattgagaatttatctggagttggggtgggacagatgggctgggaatctgtattttaaaagttgcggtatcctagcgaagaaacaccactgagagaacttcatctcacaccctcctctacctcctctggtccttgccgtcttccaggatccaaactctggcacgagttctctttggcagtgtcccagctaggcctgtccacccaccctctgtaaagtgggtgcagctagatagtggggcttgtgggaagagcagcaaaacaaggatagatcctgggtaggtcaacagttatcagatgggcagagaaagagggttctctgaaagagactgggaagaaagggccagggaagtaggaagaaaaccccaagattcgactcaaaggaggatggagagatatgacaagtcactctaggtgtgcctgcttagagtttgcatcaggatggggataactaagttgttctgtcatttcagaagtggaccatttggttgcagaggagattttcctggcaagtcctcccttccctttagcagatagtttgtgccacaggactcattgacaaaggcatccgaagtctccaacaggaaaaatttcttttccaaaagcagggcctttgggaacgagatgctgtcagccactgagaggaaagttagcagatcagggtgttttattttactttcctctcttgctgagttctgggacatgatttatcttctattgggaggtgctgtgttaagccacgtcaaggtcattaaaaatatatgcatttggcatttggaggtcggggagagtttggagtctgccttctactgtttctggcatctgatggttgtgacagtggcaaataaaggcctggaggccaagtgtaaccttagggaaggaaaatgaaaacctaccacccttctcttcatcaattgtctccatcacagctggggtttctagtcggtcataaggggcactgctcaccttccccatctgccccccagtaggtatgttagttcagctctggaatcttttaacatttagtgaagtccattttaaaaaggaaaaatgaaaggaaccaaaaaaaaagcagaaataagcaaaggaagtaaagaacagttaagcagcacatggctcgctccaatgtatccttcccatagcagactgagtgagcactccagaacacaaagcttactctgaaactgcagagctcaaacccttcaagtggtttctccttgaacttagcagtgaatccacatagtactctgatgccagctgacttttctagccttgtcacccttcagttccccttcacacactttctactccagtgccatgtctcctggattcctaagcaagccatgcctttattcacctctgacgttttgcacatggatgggcacccaccagccactcaagtgtggtggtgaatagtacagagtcaagtctcattttgcctgggcgtcatcccagatgtaggcaactttctgatcctctgtaccttcatttcctcagttgagaattggggctaccaagagaggcaccttgaggattagatgtgacaatctgtgagaagagcctagcagagggcctggctcagcacacagttagctgttacttaacaaacattgattgtctgggtgcccagtaggtgggaggcccttatctgttcatttgttacaagctatttgtagtctggtggaaaggcagacatgaaaccaagacattataagacagtgtgatccagtggcgctggaactgtgtgggtttgtaccttttcttcagctgagctcgccccaggtgttatctagaattcaactcttagccaggcccgagacttgaggaagataagagaaagtaaaatacttccaccctgggagaggcatttcagacttgaggcactagcacagccccacagctattcaaatgttgaaatcctttcctactgattggcaagtgccctgaacaccccaactgcctgtaacccctcctttccttctacttcacacattctggcgtgcattggtcggataccatcagagactgtccttgtctcctgccagggtgcaagggtgctagcctgtcttgttgctctttagctctggttcccctcaacccccaacaaggagcagccctgagccctctgagcaaatgcaaattccatacttgttctgcgaggctacattttcaacattacatatgcttctccttggggatattgcctgctctgagtcccaggagctgtatcggcttgctttgggggatgcccagttcagccttcttctgggctatggtctatgccagcaatatcctttgaaaacctctgcctgtccaccaggggagatttcttccagctaaccatccactctactgcagaggttcctgtcacctcctagttgttcctactccattctgtcagtgttacctgcactatgctaggatttatcctgacttatgatgttatggacaaggtcctggtgtcctgtgaagtagtatagagtggaagctttggagcctatctgtgtttttcaatcccagctccagcacttcctagctctgtgaccttagcaagttactcagcctttccaagcctctgtcatctcatctgcaaaaagggataacagtaatacataccttatagggcttttgggaggattatataatactgaaaagcatttagaagaatgctgactcacagtaaaagctcaacaaatgttagacgttattattattgctattattattattttgtattgaagctctttttttttttgaggaaggtcttgtcacccaggctggagtgcagtggtgcaatcttggctcactgcagcctcaacctcccgggctcaggtaatcctcccacctcagactcctaagtagctgggactacaggcaagtgccaccatgcccgactaagttttgcgtttatatagatggggttttaccatgttgcctaggctggtgttgtactcctgagttcaagcgatccacctgtctcggcctcccaaagtgctgtgattagaggcctgagccaccgtgcccaaccatactgaagctttagtgggcttcatttaggtatattttcaaatataattgcctcttttgatgtacataaccgttctaatgaggtaggtataaaagactattggttagaatcccaatttttgaggtaaagaaattaagacttggctatatgaagtgagatggccatggttaatgacaagttttatgatttcccgtttaatgttattgttctccaccagaagacactgaaatagatggattgttatttattcaataaatatttattgaatggctactgtgtgccaggcattgtgctgggcgctgagggtacagtggtgagcaagacagacaggtccctgtgctcctgaagttaccattttagtggaaggggacaatcaataagcaagtaaataacaataaaaggtatatatcagttagtgcaataaaaattaaacagggcaatgggatacaaagtaattaagggagataaggtagtgaatgaaggagggtttttctggggaggtgactttcatgacaagtagatgagctggagaccttctcaccttggatatgtagctaggttctgggagagaagtcctcatgaagaggggatttccaaggtcctactctgggccaccatagacaagtggacaggaaggagggttgcaagataagggttgctcagagcccaaagtcagaaagacttgctaaatttgagattttctggaaagaggcaggagagcaaagaaacttttagcagtggaaagggaatttttttccttataggtacttattaagtttaaacattttaaaagtaactttattgagatataatttagatagaataaagttcactgattctaagcatacaggttaacgagtcttgagaaacatagacccctgtgttaaacatcgcctctctcaagatatacagaacattttcatcaccctaaagtgttcccttgagactttcgcagtcaattctggctaggtattatgtagaatgtccctcagtttgggtttgtctgatggtttctcattattagactagggttatgtgttttttgcaagaataccacagaagcgataagcccttcttatcatattatatcgggagatacatgatatcattgtgtctttcctggtgatattggccttgaccatctaattaagatgtaactaacagatttctccattggaaagttactacttttccctttgcaattaataagtatcttgagagagacactgaaactatcccataaatatttgatttagcactatataagacctatatgttgaattagagagtggtgttttgttgaatttagttttaccagtcaagagcatggtctatttttactattcacctgtttttatttttctcattcatgttttatagtttgttctttaataaacatggatctggattaatgggaagacaatgtgatagaaaggaaagagcatagtatttgacacgaggcaaacctggatttgaatcccaactttcccactcactggttagatgaccttgcaaaaggcctgactcgctaatttctcatccataaaaagtggctgggaagaaaccatctcacaaggtttttgaaagcattaaagcactgagtagtatctggcactcagtaagtgctgtgtaaatgtcatttcttgcctcctttaatacccaagtgtttaatattgttgtcacaattgtgagtagactcctctttctggcagggtggccttaggatataggaattcaacagattcttttagatttattttatgttctgacaccacagaggctttggctcgggagaagcagtgaactttttacatgtctctgagtcactggggagactgttttaattgacagcaaattattgcagctcaccagtatctcctatcctagtacctttgcaaaactccttcattacctttggtatttggggatttgattttcactgatgtacaaatatactatttgcaaaagcggcatttttttccctctttcctatatttctactttttgtttatttttcttctttcattattagaattgttttaaggtagaactttaacacgggtaatcttgtgcagttcctgtttttacccagaataaatctcatatgagtttttatttatttattttttatttttgggggggtggggggggaaagggtgtactcttatcatattaaacaagagagaaaacactgcaacacccaccctcacccaccccatctctgatttctgatgtcttaagacttaagcaaaactttgctttccttgtttggtctttttccttgttccaaattttatttccccttttctaaacttttaatttgttatttgacatgaggcaaacgtggatttgagtttacactggattttagtttaaacctggattttattttactttctttaggcaggatgtcactgtttctttttttattctgatataggctttaagggcaacacattctctaaatgctgccttggcaatctcccagaaagtgttactgttgtcagaaaaaggggtcctgatccagaccccaagagagggttcttggatctaatgcaggaaggaattcaaggcaagttgtagagtgcagggagaagagacagtttattgaacactgctactcagttacagagtagggcgtcctcagctgctactcagttacagagtagggcatcctcagctgctactcagttacagagtagggcgtcctcagaaagcaagaggaggaacgacttgtctttaagttttcttatatagtggtcttattttctatgtaaaactaagttatgtctacatgctggtgggctgacagcatgacaatttattattttgctgatgtaaagaaaactattcttggcattttagcttgtaagcacatcaaagcatgactataatcaacttaaaagcatatattgttatgcgatattgggacatctgaacattctgctgtcgtgggcatttatccttacaggtattattaagctgtttcctcagccataaacatcttatgaccatgggccgtgactggcaaggaatgtgccttattagttttaacatggaattgattttaaaatggtgtcacctggctctcctaggctcctgtttctctaacattactcccatgaaatcagtcttacaaattaatttttccttttgcctcaggctccattatggcttggcatggcactgttactgatcgtgtgtataaaaatttttgatattttgttcatcacggttttttggcattaatttattaaaatattatttgattatggagtttttgatccctgaggcaagtacctctctcacctcattccagtctagttctggccttgtaataacctcccagacaagttttgcttataattttcttttgaaatggaagcctgatatcagagagactgaaactgttattaagccaattgtaccgcctgccaggagagaatcatgctgtccttttctgctcctttcgcctctttcttactatatgccagactctcagctcagcagaagtccttgtccatttccagctgctggcattgagcacggccacattgctattgggatgcctggggttacttcttcatttagagaggtcaaaggccagggtcttattctccggaaataaaccccaagggctattgagctcctccagacccttgacagggcccttgtggcccaaagcattcctttctctgctggaatctgtcagttagctctggcaaaaatcaagtttcctcgctctgaacttactccatccacacaagtttcccttagaaattatggaaaagaaacttgttcgtataattctcaaatgtcagaactggaaaggccctgagagaccatcttgccccaacccctttcatttaacagaacatgtaacttcctttgctctatttccacgtttcaaggaatccccaaggctgcctcataataaaaatcaggaacaaggtaagagccaagttaatcaaggaagtaaactgctatgggacccagctgtgctcagggaggactgaatcattagaaatgtagccctggcctcgagatttgtttattaaggattttcttcaagggcaaagagaaggatctgtgatggctcaactccaaagattttaatggggtggggtgagactcaaaaagattccatgagctttcagccgggctggagagttgtaaagatcctgctttgaagaagcctgcctttacttcttctatctgactgggtctggcatcgtggagaagttggcaaagtttgcctgtgtgcttaacttctcccaaaatgtgtctctctgggtcccatactcagaggatatgctttcagttctgaaatgtatcaagagggcactcctgtgttaggactggcattgaaagtcacatatcattcacatatctacatttgcaacaaaatccaccctgtgcaaaacaccatcacatctattcctctagtttaacctgtaaacaatgtaaggtaatttttagctacattttacagatgaacaggctcagtctgcaggattgcctaaggccatgtgactagtaagaggcaaagctttgactgttgagtccagaaggacaccccatcctgtgcttgttctactaagccgcaacgcctcaagggtgccaaagtgtgccatgagagcacacagtaaactagctaacaagggccgcagggttgaaaccactgtcttgatctgatttgcagtgaatgctagcactgtgattgacttacaggacacatagaacaaatctgggaacttactgttattcccagagaagacactgggacattgggccccaaaggaatttacccatcttggaggtttatgttcttggaaaatttttccttcagactggaagaagacaaggatatctcatcaactgaaggaaattccttataaggaagctttattcacacacaggagaggatcagatcccactgtagttctgggtagtatttagctatgtgcagtgaacacttttgagggatgtgtgtgtagcaaggcagggtaatgggtatacgctttcttcaactaaaccaagaaagctgtatccttgggattagaaaggggattatcaagttagttgtgcagttcagggagaaataggaaggccacaggtgggaaaactctaaatagactgtgaactgagattatttggacaaaccagattacttagggaccttgacatggattatatccctgtgtcctcggtgctcagaaaataatccagggtgagatctgaatacaactccaacactgtatcaccattcctggaaaatgagccaattcccttctcttgtcttggaaatagctgatcaaaaaacaatgacacatttattattatttttttttattttatttcccagtttgttgacacctcttacattcacaggcaactgctcaagtgtattgggaaatacagttgtgtattgtgcagttgactggcctgatggtgggggtgctctggctgggatggaatgctgctaggggggctaagatgaagaggagtcaaggatcagctcacaggttagcgagcagccagtccagcaactgtttcctggccacctttcccacagcttcatctggttgccgttccttggcaaacttcatgacctcttgaagaagacctcctacactgtaccccttctctgctgctttagctgaaacctgaggaagctgtggggaaaacagagctagtgtgagttgcgtgatgctttttggaggaaagacctgctggacgaagttctaccacccaaccccctcaacccctaacctcctcacccacacccaccaccttcccgcccatgattctaggattagggtacagcatgtcatagatctaggactagaggctgctgacacatctttccttttcccttgaaacttctctaatgacatagatcaaaatgccaaagatactttcttttttgagcttcaaaaacacactctgaaattagttgtgttcattaaatacttttcaccagatgctggacccttcagttagtctgtgctgattgctaggtcaaggtttggggttgccattcccccacctccctaaaaaagtatgagacttggagtagggacgattgtctgagcttggctcctggactgaaaataactttgttaagtatttgatgtttctggaatccatctaatgcaggaaactcagctgtcagataggtgtgtgtgtgtgtgtgtgtgtgtgtgtgtgtgtgtgtgtgtgagagagagaaagagagagagagagagagagagacagagagagaatgtgcatctatatgaatgtatgaatgctggcctccatggaatctgaggagcagggccaggactagggtcaggcaagtgaggcacctagggcataaaatttaaggagacaggactctcagggcacttgcaggacccatgagtttgggggaggagcatagggaaaatagtaagagacaagtttcaaactgtttctggtaggtcaaacacaaaattagtccatgatacttccaacacctcaagaggtagggaagaactccattttccttttttgttccctcctctctagagtactttgggggatcttaaaactcaaaacataagacttaatcattccccaatgttttatcaaatagtttgtcaaaagggtcacggatgaaatgcgttaatctcactctcctcctcttggtggaaatgcacaggctttgaggtgtccacttagctagtggttcaccgtttttgtgtctttttatgaggtgaaagtaattcatgaagcacacggtaaagaatagacttgaaactcgaatgatcttgggctctaagtacaatgctgcctccctgcctctgcccattccaactttcttcttgtgccttaatgcattacttaccttttccagttgtccatccttatctcccatgaagtagagcatgggcacgttaaactgggaggctgcaatccactgcaggacagcctggagctgcttctgcaagctatttgtagagcactgattattgacaattacttcatgtccaagagagtcttgatagttctgtggcattgcaccactgtgaatgcatctggtgcccctgaaattgggcttatttgccgaggctgcttgttcttccaactcagcaagggctgccccatcgttgctatacttagccatgataaggcagagcttcatcacagattctactagtttatctataaattgcccgttcgcttgcttcatcccactggtacagtcaagttcttgatgctcctggcattgttcttccgctttgtcagatctgttggacatggaagctgctttgcttgccctgggctcagaacacttgttctcaccttcgcatggatcctcacatttgaaggggttctcattaagcagtttctgaatcagcattagaacgatgtttgacatatccattttctgggagtccaggtgttggttctccttttgacaggtggatggtccaggggctctgtgagattctagttgtttcactgaaagtgctttggcactttggccacctccacacttttcatattgagtactctgagccatatagcccatggtggaaccaggacagtcttcttcacatgtatctttgcccttagtctgctgggtcagatggtactggatcagcttaagggcagagacaatcaggtccttggccagtgaatctgtggaagcattgatcttttctcctttctcatctttattgctgcatgctttggtagccaccttgcatgagtttccttgcttttggttccagatggttaggccctctttgagaatgtgttcaccgactttctcagcactagtcagtgacttgcatgggtctgatttcattttgcctttgtccctctctttcatttcagctttcatggtggagaattcaagactctgattcctgcatttgggatcatgggacccagcttttaaagatgcatatgacagactctgagacttagtctccttctcctcacctataagggcactgaccaagcgcttcagcatggcctccatgatgtctgtagcattttgtttccactggttgaacagatttctcttgacagctgagacaaagtctgagtcagtcatcaggaccccagtaatattatgcaggttcttcatgcaagaatcaatcaaatcggacacaatctccttggtgtgccttagcaacaccctcttcaggaccacagatgctggaattggcttcccagagctgtgcactttcaaggtcttcatgagagagaccatcatgtcagatgccacctgatttgcataaaccatgagccccttgctgatggaatctgcaaattctttgctctctctctgggacatctgtttgtctccacttttgctcttgttggataattcgctatatagaaagcttttctggccaccttccctggactcctctccagtgccacgcatttctgcagctgtcagttccacagcttcataggccatttcagaagcaatcttgctcgcaggagttcggggactgattctctctttgttcccaggggatggacagattgaatgatgaaggcatttgcttttaccttccaacttctccttgatttccttatgggccatctggattaccagagaagatagtcggttgacgtagaaggaaaggtcatctatagaacattctccatcaggggaaatgactgctctctgagtgctaggaggtttggctggaggagctgaaggactttgattattgttggtgtttttagctgctgtcatttctagacgtaggttttgaggtctgttcatcaaataatctatgttcacttgatcggcatagacactgtagcagttctcagaggatgctctgtgatattcgccctctgtgtctcctactttatgtttacaggtagaggttgaggggctcagtgcatgttggaaacccaaggcatacttctggagatcactgagaagccagttgaggacacttacaggatcagagggagcttgtttgaaaaggcatacagatccctctgtctaaaaaaagaagaagacctatccataagagtttgggtaggctacttttttcccttattttatttagaagatgtatcagattagggatttgaccttttggagtttgtatgggaacgtaacatccagttatatccattagtacacattcaagcagaagtggcagcaacaaaagttcaaagtatatacatgtgtatactttatagaagggttatcaatatatgtctgccaactcatatgaatatgttgtatctcaatgtgtcaaaaatgtgtcagtgtgtctgttgtgtgtgtatatatgcatggaaatatagcagttcacatgtgtgaacatctcaaagacgtgagaatgtgccattctgtattgttagtgtgtgaaaatgtgcttctgtgtgtgtgtgcatatgtgtgactatgtctaagcatgtgtaataatgtgttgacatcattacctattgtatatgtctactgtataggctgacatgtgcatgttagtatgcatatttgtacatgtgtgaatgtcaaaatatgagtgtctatgtcagtgtgtctctgaatatgtaaatgagcaagtgtcaatttcagtaatctgcatatatgtgtgtaatataaattcactagtatgtatcatgcagctataaatgcatttatgtatgttaaagcataaattcacatattaacatacacattcattaatataatagatacaattttaatatattaatgtatatgtatgttaaaacatgaatatgtgtaaacaggtgattgtataatgactatgtatgttcataaattgggtataaatttatgttatatttatatgttatgtcaatatttgaccatgtgtatgtcaatgttgtacataccctggtatttgagtatgtgtgtgagtaggtgtgttattgcatttgtgtcaacagtgtatgtatcaatacgaacaaacaagtgtgttagtaaatatgtgtcgcttagtgtaagtttgtgtgtatgtcagcatgactgtatatgaccatatatgtctttgcatacatatgtatatttataagtgtgtataccaataactgagtctgtatggtcactatgttttgatcaagtcttatgcatgtaatgtgtgtgaatgtatgttcatgcattgtgtaatatgggtgtttatgtgtgtcctgtgtgggcatgtcactgcatctgactctgtatgactttgtatatctttgtatatgtgtgtcattgtttatgatcagtttaagtttgctacatcaatgcttgtgtatgtcaatatcaaatgtagccaagcatgtatttataattgcttgtataaattgttttttgtaaatgtatataaatgtatacattgatgtgtgtatcattttgtataaatttatatgtgtatacctatgcctgtgactgtgtatgcccatgtccagatatgtgtatatgtactatatacacatattccacccaacactaactaccaagccctctgctccttctattgcttcatctcctctcttttcactgaatttctggaaatgtgaggtcatgataaagtcaactttttgcaaatgagcttaagttacaatcaagcagatctgcattgtatgtaggaaacatgggctgctttttcaaaaattaatgccaggtataatttatccctttcttaagactccaaaattgagttggccatacccaagtaaactgaaaactctttggatactgtaatgtaaacttgtttttccttccttgggggccactcctttctggagtctggggtcagaaataatgttttggttataatatgagcctggagacacagaacaagaaacatttgattcctctgcattaaagtcaaatatcctgccctattaccagccactccaggcttgtaggtatgagagggtgacttgttgtatgctccagtgccctcccaaaaccaggaccctaacagatataattttggatacttaaacaaaaccaaaaggagtttgtatgtcacagtggcatgcaagtttaattgcttctaactttaagctactcaacagcctaggtaatctcttagacaacagggtaaggatgaggcactcaaattcttggtggttatggattgtctctgctccatacccctctttcttccctgctggatgctgggcaatgtggggcacacaagtccattaccagccagcgaagaacattacaaatagtcttgtgtgattatgattggatgggtagctggaaatcaggagagggcattctgagcctctgtgattagtgccattattaagtacctgggtgttgaacttactgtggtcttgaacttacgcctgtgttctctagaatgtcatagtattcaaattgatgagcctgtttgacagtaagtgtcttaccatgtctgatccagagtcctcagactcatcattgagctctgagaattagaagtggtgggatctcagaggttaagtgtaccttagactggtctttcttctcagtgtccttgatcacgataatctctttttcttccagacttcccaggtttaagttgccttctgagctggaactagcagcatcctatggaattaaagggtgagattcttaaacagttacttttggatatttctccaagctgcccccctaggctatgacttcaaatcatgaatgttatgacttcttttatcttttttctttctgcaggagaggtaggcttgtgaggctagctaatctttgaagaatgagacgaagttccctccacaaattactactccccactctgaagatgctcacaaagccaccagtctcaagaactatattcatcaccctttggatgggtttttttttttaaataaaaaaataaaaaacaacttttctgacatgctatcttccatgttttatctctttcagtcctaccagcaacttaagtggcttctaaaatgagacttgatatcaagagtgacggtaaattcagaaccagggatcttgggctcatgagaatgctggctttccccctgagtcccctcctcctttcccctctctccccccaacattttccattcttcatacttcactgataacccttctcagcagcttcccaccgattctgactctgagcagagaatacgcaccttgtaatctttatcttctacattcagggtggacacatcgacaaagcatatctgcatcaaattagaagggtgaatttagaaaaactctagagaaaggggcataatttctctttcttggagatgataatagcacctacctcagagggttcttgtgaggattaactgagatactatatggaaagcatgtaaaagcagattgcctggcacatagtgagtacccaataaatgttaatactgtgattattgttaggcagacagaatcttagcattagcacatttcttaaatgagaataccaacctcctgtcagagtgaggcctgaggtacaatatccacatgtattaattgagaaaactgtgaagagaaatggcttgcccaactgacacaaacttaaatgtggagcttgtattagaactcaattttcctggcttccagtttagagcacttgctactacactagtgtttctcaaaatttattttattatcaataatatagaatattttaagtagtgtatggataaatatttctgcatttaataggtgaattttattgtgcattagggagaatacatactagaacatcaaacctgggatattatggataatatttcttagcatgattgtaatttttaaaatgtaagtcaatttttaaaacattgtaaaaatacatattaattaaataatagtatgcgtgacatttgaacatgattgaagactgtgaagccctgtgaattacttgaagtttgggaaacagaccatgaagcattttgccctcctgaggggtcctagggtaacattgttagctaggcaatattattatgacttaagaggtcttaactaatagaggctggttgccaggcaaccaccactcctccctcaggctcctccccagcctcccctccccaggtcctttacatcacaccacaccctgcccctcccttgatttttatctctgtgtgatgtatgagcatgctggcccctgacagaccttgttgagcttggttgcttggagaagtcagggtatcatcgtccattagtttatcttgggccccaggatatctatacccatatgccaatttttcctactcctcggcatgagtcattttttatcttaccactttccggtcctgatcttgctgtccttctgggttgtagagatctaccttgcacacacccctgtggctgcgtaaccagtcaatatcatcagacatctggaaagagaaagaaaagaaagctgaaatgcttatatatggtttttggaaaccgggtcaatttggataagaatctctggaggggttctgaaatccatttctgtgtttcatatataggtttaggctaggaactggtggggtgagcagtgggggacacattgagatgtttgaacttgatgcttaggatcattatcttttagcaaaatccatagtctcctttaatttagactccccacaccaagtatttggaatcatgagagtatgatgacctgggaatcaaatttaaaaggaaatctagtgactttggggattacatttagtgatttacttctacccaactctactaactaaatgtctctgatctccacatttctttaccccctcgagtaccttcaaaaaactccagctcacgttaccccctctaacttaattctagctaactccagttcaaccagtctttcccattacactaaagaaagtgaaattagataaatagctataacacatcactcagagccattggaaaatactaaagtcaatagcagtaaataaatagcccttttattaaaacaacatatacaatttcaatatatagaacaagattttgaatgctgagaaaacccagtctaataaccataaatataacaccgagagacagaaatctgagggaagaccagaccctgatccaataggatcaagtttaatttattttagaaagaaaaaataatctctgccaacttccttccaccatcaccccctgccaccacctcccaacccagtctggaactaaaagtaaaaaggaaatgacaaaagccagtgactgatttttgctacgtaagacctgagatttatgcttagaacacacagttaagagctcagtagacttgtttttggtatctggggcttgaatttgatttctttttaaattttaacaagagaaatcctttttgccaagtattagagggctattgaattccccctcccaccctccccactcccgctctcccttctgcccttcccctcccctctctccccactcccctccctccctcccctttccattccctccccctttctccccctcccctttctcccccttccctccccctccctccccttctctttctccctccttctttccttccaccccttctctattcccctacagcatattaataatagctattctctaatggctatcctttcacatgataatactacattcctgctctttaccatccctgcctccaaccaagatctttttgaactcttccttcaggaatctctgtgaaaccttgaaaaagttataggaaaagactcactctgaagagggagtttctttttttccaagagctacatagggaacactagcctagtaaaaaaagaggtggaggcatagagtccctcatgtgattcagaaacagcctaagtccaagtccaaaagaactgtgaaaaataaaatttatgaactcattaccttgatgatgaagttcttttagatgtttggctgaaaacgtgacacccagaagggagatgtgcccctttagatggaactgagaagtgccaagttcttgggcacctgcagttggctgccacccctgtcagctgttggaccagactgaggggccaggctttcccctgctgcctctgaccctggggtgtggcaacagagtttgttgggtcacaatgcctgaactgtcacaacctaagcaaaggtgggcatgttggcaaactcagaaacctattcccatcaaaagcacatcaggctgcctgtggtgcgacaaactttttctgttatctctatgagggtacacaccatttttctcacattttctctggctcacagtccatcaagatatcccttctcttttcatttcctgcgagacctccagaacaatctaatcatacccctactagagaatcagagttatattgcaagagatctttagatttacgtagaaacagagaaatgttgatcaaaatcttttctgggtatcccaaataaaagtatgaaaatagaaacttggaggctgcctcagcagcttctgtagtttcacctcaccattaagatgcccccttagctagtcaaaaagaagtcagatgtccctaccattgtagtatcagagtacgccatcatgtaggaccctggaatgatgttttcttgttgatttggatgctgtgatgactcttccagtctgcctcaagatactgcttttttcttcaactctccatgccctcctacagccttgactgccagctggtaccagagttacctcttcttgacatcaccgtttctatagagaacagtgacagcacaaagatggagggctctaaggattctgtgtgctctaagtggtctagcaggctctgaccttccctatgagaaataagttgtccagagaaaggctgatctagttgagacagggtctgtcttttacagactccctaggccatgaaaagacttaagctccacttaatcttttcaatctggccagtgctggtttgttggctgcagtatgtgttagagatttatccattacactttgagatgccttcatctcatcttactgagtttagccccagtttggaaatattatcccacaaccaaatgtctctcactctgcccaagtctcatctttccttgtcttttctccatgtctccactttaatactgcatgcatgtaaataaatgcatctgaattaacaatcagttgagatgatcccctaaaagagttccatattcttggttctacctccatttattctttttcctgttgcccctgagattgcatctctaactccgctatattattttgatcctgttagctcatggtgtcaaacagaaacagagcctggaatttgttagaggcggcaagacagattttattcaggccactgcagtagaggagagagacttctgatgaacagatctcaactccactgaaacaaaaggcagggtgtgctaaggaaaagtaccgaaggacattgagtgggggtgagcttggtcaatgtattggggcatctgtgtttgctaatgggtgcttattaaagttaggttccctatgttcacaatgtcaggtttataaagaaaaacataattaagaactataaagaaagaaatgaaagaaagtaaaatcaaaaaaagaaaagaaaagaaagctaagctcctaccttcccatagagacagggagacatggaccctatttttcttgatcattacattacaaagggatggcttccaggttgttgagaaagacagtcctgggttgtagaagatacatcttaaaagaagagagaaagaatttacaattgcaagttttctaaagtacatgctgtaaggaagggagtcagggcctgtagtcaggttttggcctgaacaaacagtaaattcttttggcagcaatgaactgtctcaggaaggcattttaaggggggctaggattgtcatactagggaaatggccttttggcagctttgaactgtctcaggaaggcattttaaaagggctgagattgtcatcctagggaaatggccttgagctgatagaaactacgctggtgtttgttcaagtctcttagtgtgtgtatgtattggggggcaggtggatgaaattgtgccgaaagttgcagttcttataggccaaagttgaggcctagctgagaagtgggcttagagaagcctgactaaagtttgatcatgaagagggtctttgttgcttttcctataccatccttttgtcaaggggcaacttttgatgattaaagacaaagttggagctcctgtgtctggctcatctctgtggaatatgaagcaaaggaagaaaatgtttacctattctccaagcacaagaaatcatatctctaagagattaaaaataaaacaaaacaaaaacaaaaacaaaaactctgtgtctcccagcccggaaaggaacaaccatgattcatgcctggaaaatgtcttagtaatccccagatgacaaagagagaactactatggatgattagagcactctcccagggcacctgaatcctgtcatcctggaggctaaccaggagcaggtaagggcagcatttggatgtgaaaccaatgagcaaaatgtaagggaagaatcaaggcagacctggctcagtcataggtcacggtacatttactgcctcttccttctcttctcgaggctctcaaattggtctgtactgagtagagggggtggagggcaggtgagggataagggatattcaaatagtcaaagtaaggaatatattgtattagtgtgtgaaggtgtgtgaatagtctgcacttaggtttgcctttaatagccaaatattgagatattaaacacaaaagccttggtcatcattttttttctaagcaccatcatctattttgtaaccttgtttattctacccaaacttcttctctttcacacaaacttgtgaataagagtgcaaatcaatactttaaatacactctcggtttgcatttggctagaaaaaactatgaagataataaaaatgggacctgcgtttataatataattatcatgaataatggcaaaaggaaattaaatgaagtgaaccatcagccttcatgaaatcactgtctgtctggtagtcttgctgggtgtcttccagcctcagatttagcctaccttttatgtgatgacacaatgaccatttagaaaatgggcagtgatgccaatgattatcagacatcatttactgtggaccaatataattgggaacaccacttctttttctcctgatttggttttcctgccatgagagtacacaatgacatttagagcagcttcatgcaaccatactaaagtgaaaaattagtcattttgaacatcttggcagtggaactgtataattacttctgtcaagtgtttgtgttttgtctgcattgtacatattttttctttcctatgagtgattggaggagtggagggggaaaataaaggacttttaaagtctataaacattatcataaaaaaatttcagggggcaactgctaaagataagtggagtcttaggaatgttaggggttcttttataggcaggggcttaattaggcagctaaagttctgttccataaccttgcggtagaaaatgacttatggctaattttgaggggtgggcttggcttggcagtggctatttctggtcaggctcttcccttttataattatgaaatttccttcccctgatttcctagaacatttgcttattgtcaggataattcatctgacatttactaaatctggccttgtagagttaattaccttttcctattcctagattacctacattgcaagcctagaaggttatctatctctttttcattgcatccaccacaatactgggcacacaggtgggctcaagacacaaggttttggaatttttagggcagaaaacataattcagaaatcacagcgtcatgggatctgtaaaaatgaccaaaaaacttggttagctatctgagtgggcaggcttctttcccagagcagtaattgtcacactttggcgtgcatcagaatcacctggagggcttcagtttctcattctacgggtctggagtggggactgagaatttgcctggtactgtgtattacatgcattatctcaattcacgcacagccttatgaaatgcctaccactttaattataaatgactcgctggagcgcagaggccacgtgactggtgggggtgcttggcagcactggccacttccatcgtcttgggggtgggggtggcggggcgcgcgcgtgtgtgtgtgtggtgattagcatgccttttatttctttcagggtctggagatagaagagaaattccctgagaaaaagaaaagtagaaaggtatttactctgatcttctggccccatctggtggttttaagtctgactaaaaaaaaaaaaaaaaaaagcgctgattcgtgatctccccctgctggtgagaatggtggggtcaatccggccgcctctcgtaccagttgttctgaggtgcatttctgtggaagcatttccgtcattctgagacagttgggctgaggcggttggtcgcctctctctctctctctctctgttcctcatctacattttgattggtttatttttgtattgttttctttcagtttccgataggtggagaacattctgctaatagcttttcttccagtccatttgtggcttgttaaaggtacaacatgtattgtcagtcgtgacgagagctttttgccttatatattgattatatattataaatatagaagtatatcctgtgtcaggctggagatgtgggaggaaaactggctgagggaactagcctttaattagtttatttcctccctgtcaaaccaacaaacttttctggaacatctgaaaaaataacctttaaaaagtacttcaggctgaccgtggtggctcacgcctgtaatcccagcactttgggaggccggggcgggcagatcacctgagctcaggaattcgagaccagcttgaccaccatggcgaaaccccgtctctactaaaaagacaaaaattagccgggcgtggtagcgcgcgcctgtagtcccagctactcgggaggctgaggcggaagaatcgcttgaaactgggaggcagagttgcagtgagccaagatggtgccactgcactccatcctgggtgacagagcaagactctgtctcaaaagaaaaaaaaaacttaaatatacagttacttggtgacaaaatgtttatcctgccctgcagatagtgtatcagtgaatgaatgtattaaacattacagctgggtgcagtggctgcggcaggaggatggcttgaactgggaggcaaaggttgcagtgagccaagatggcgccactgcactccagcctgggcgacagagtaagactcttgtctcaaaagaaaaagaattaaatagccaggcgcagtggctcacgcctgtaatcccagcactttgggaggctgaggcaggcggatcacgaggtcaagagatcgagaccatcctggccaacatggtgaaaccccgtctctattaacaatacaaaaattagctgggcatggtggcatgcgtctgtagctacttgggaggctaaggcaggagaatcacttgagtccaggaggcagaggttgtagtgagacgagatcgtgccactgcactccagcctgaacgacagagtgagactcttgtctcaaaagaaaaaaaaattaaatagctgggcacggtagctcacgcctgtagtgccagcactttgggaggctgaggcaggcggatcacgagatcaaaagatcgagaccatcctggccaacaaggtgaaaccccgtctctactaaaaatgcaaaaactagcgggacatggtggcatgcgtctatagctacttgggaggctgaggcaggaaaatcacttgagcccgggagacagaggttgcagtgagccgggatggcgccactgcactccagcctggcgacagagcgagattccatctcaaaataaataaataaataaataaataaaatatactattacttggtaacagctgggcgctgcggctcactcctgtaataccagcaccttcggaggctgaggcgggaagaaagcttgagggcaggactttgagaccagcctgggcaacatagcaaaacttccgtctctaccaaaaaataaatgaaataaaataaaattagcagtgtgttgtggtgcccgcctgtagtcccagttactcgggaggctgaggtgggaggatcacttgagcctgggagtgggaggttgcagtgagccgagatcatgccactgcactccagccaggacgacagagcaagactgtctcaaaagaaaaaataataaaaatgaaatatagtattactttatgacagctgggcacggtggctcactcttgtaattccagcactttgagaggctgaggtgggagtattgcttgaaggcaagagtctgagtttgagaccagcctgggcaacagagcaaaacctccatttctaccaaaagaaaaaaaaaattagctgggtgtggtggcgcgtgcctgtagtcccagttactccggaggctgaggtgggaggatcgcttgagcatgggaggttgatgctgtaatgaggagtgatctcgccaactgcactccagcctcctgtgcctcttgctctcaagtcaggatgatgaatcggggtaatgacttcatgtggtcactaggaggtcgcagctgttggaaaacgtattcccatgcagtaggagaacaccccgtaaaaaagccgtcttgagaaggtgttcctccaattaaaagggaaattggtgatttctcttgacagaatcactccccatcctaaaaactgcatttttgtgtatgtcgtatttattgatacatttccttaatatttccattatgaagatatgtataggttcaaggaaggcagtaactgtctctgtgtacaacctagcagtggctcatgtgcttagacactcagtaactcttggtgatgttgagatgattatgacaatagtgatggtgttgattataagagtggactcaatcatttgtgtcttctgaaattctcaacagttttacattcacctagtgaatttataaattcacatatcacattctgccttgtggtgtatttgtttcattatgagctttatctttccaaaaacaggacttcttgaagagaatgactgtgttttgcccattttcacttaccctgctaagggtagcacaggttcatatatattagcaaatgcctaatgatatttacataattgaaaataagtggtaatggttcttcaagaattgctagccccaggaccacatagaagtgcttggtcaaggccaaaaacattgggtcatcctgatccaaactgcctggattattgtaataactggctaactgattccactgaatctatccttgccactcttcaatgtaacagtttttaggaactgatatactttattagctactctgttattttttataatagctttgttgaaatatgattcatataccatgtaactcactcatttaaagtgtacaactcaatttttttagtatattgtgtcacagagttgtacaaccattaccataatcaatttagagcttttttaatcacccccagaagaaaccctataccctttgtccatcacactccagccacccctccacccctatatctcccagctttaggcaaccactaatctactttctgtctctataggtttgcctattccagacattcagtataaatggaataatacaatatgtggtctttggtgactggcttcgtagcaaaactttttccagcaatgagctgtagcaacatgtgtgaaatgtctgtgagggaagctcattggagaatcagtggcaagggtttttattgggggctggtgatacaggcacctcctgcctagcacataccgaaatttcagatttctaggaggaaatctggtgttcaccataaaccataaggcaaagtgagctcatattatcaattagtgttgtgggaaccctccccaaatccaagtttccagatactagccaagggccaacctttgtaagcaggattttcaaatgacaatattcttaggtctgatatgttaaccctgaaccacacagattttgatatggattgtgttgattctgtagatcaatctgggcagtattgccatcttaatattaagtaagctgatcaatgaacacggaacatctttccatttatttaggtctttctcttaatgatgttttgtagttctcagtgtacaagacaatatcgatgttggattacatgggttgatttttcaaactagccttgcatccctgggagatatcccacttggtcatggtatatgttaaataatacttttaatatgttgctcaaatttgtttgctaatatcttgctaagaattttgtttctatattcacgagggatattgttctgtagttttcctattttgtattatctttggatggttttggcatcacagtaaaagtgttctcatataatgtgttgggaagtgctcccttttctattttctggaagtgacagatgtagaattggtgttgttctttaaatattttgtttaattctccagtgaaatcatctgggcccggagattactcttttggggaattttaaaattaataattgaatttatttaaaactgggactattcaaatgatatatttcctattgggtgtgttgtggcagtttgtgctttccaaggaattcatccatttctttaagttgtcaactttatgtgtgtagagtcgttcattgtattcccctatcctttttatgtcagtagggtctgtagtggaatcccttgttttatttcttttaaaaaacctttcattgaggtatcattgatatattaatacaaagagctgcatatatttaacgtgtacagtttgacaagcttcttcatatgtaaacacccatgattccattaccataatcaaggtagcagtcacatccaacacctcccaaagtttccttgtgtccccttgttgttgggtgtatttttgttaagaacacttaacatgatatcgaccctcttaacaaattttgtagtgcccaatactggattgttttttgtttgtttgtttgtttgtttgagatggtatctcactctgtcacccagactggggtgcagtggcgcgatctcagctcactgcaacctctgcctcccgggttcaagtgattctcctgcctcagcctcccaagttgctgggactacaggcatgtgccaccatgcccagctaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattttaaaatacccagctccaccccttcctgttaggctttcgcgtgtcgcagctgtgcacgctgattggtcctctgctggccaatcaccactgcacttcatgacggctgtagttttcaaaatcccaactgggctggtggagggtcgcaggtgtcaggttgagacggactcgagtcgctatagtaaggagctccgttcatttccttggcctctcctggtctaggggtgcgtcgatggtctttgctgtctgtcctcgatctcggtgtgaggtaggcgcctttgggcaagtactgctggctccagcgtccggctctgtcgcctgccagtgggtccttgggcgtcactccagccccttgctgaattctgttgctgggatgcgcggcgttcctgtaaggaaacttttcaatctcctgtcgatcagcagcctgtggagtgagctctgtacaagattgggcagggggagtgtttgttaaggagtgagatggcaaagcaaatgagactgggtcccagcttttagatggagcaattagtacacgtgcctgaatcagagtacttttacaaaacgtcttttcacaagtgaaagtgtgcaggattaatttcatctacaagtgcagagggatcagacatatttaagtcatagaatgctacttgcagcatgtcttttgagctacaggttgaaggatatgaagggaggatggacacgtgtcctcactctattgttaaccctttatcttcactggctcttttctgttcccaccggcaaccaccttcagctttggctttctcaccaccctctgctacgcttagaatcgtagaagatcaggtagaagggaccctagaacagcggcgcttaaatcttaacgtgcataaaaatcacctggggatattgttaatttgcagattttgatttgataggtctagtttggggcctgaggttttaaattgctaacaaatttccaggtgatgctaatgttgcttgtccattgaccacattgaatagcgaggaggctctagttccactgcttcgttttattgggtgggaaaactgggtcccagagagggaaagggacttgcccagtgtcacccagccaactaagagcagagccagaactagaccttaggcatccttcccagcccagtgctgttttattgacacaatgctgtgttctctccccagagccttgctgtctgtaacctgcctttatataaaaaatgaagttgctactacttcctgtagactgttttgatcagcttagccctgctgcccctttgtttgtttcagcaccagccctgggaggtccagtggagtctgcaacacttaccagtgtgtatgtaggggacatggaaagtctgaaaaggggaaaggattctaattttcttgcccaaggctcagggttctgtaggtggcagaagttgagagtgttccgcagagagtgtccttttatgaaaggatctttttgatagtgtcaatcccctctcctccccttctccctgggaaaattagtttacctaagtcagtgcatctgtccctcaatgcaaatgattagtgttcacgataataaatggggtatatgaccatcatttaaataaccttattttctctgagatttagttaacctgtatgttatcagctgagagttttctagcctgtgggctccgtatttctttttccttttaaaaggtaaatgtttcagagtgtgagtctttggtcatccataaaaaaaaaaattatgaggcgtaaataataatagtggagtaagtgattttcatacagtgcagttaacagtgggtgcacccaatttagctttattgctgcttggctgaggtttgaggaatgagatggaatataggtttggatttgatagaagaagaggggagtaagacagtatttattaaatgcctgccatgcatcaggttttgtacatgtaaatttgcatctgagccacacaagtcctctgcaagtaagtggtgttatagctgttttgaaaatgaggaaactgaggctcagaaatgctaagttggctggcttagaagtccagttattcaaactccaagacctgtgctcattctacctcctcatactatggcctttcactgttttggaatatttttgagtgtgatcgaagagacttcatggtattttagaaactgcccgggaaaaagctgggcagtctatgccccttaatagtttgtcctgggtagtaagttacttaactcatctgagactgtaaaatagaattgtacctgccttgcttagccttatggttttgttgtgagaatcaactgaggtaacatgtgaatgcatatacttatactggcttttcctgacctacaaaatgtttcatccttctccatccaaagcgaaacccaaatcaggctttctcctttcttaaactttcccctcaagctgcagacttttctgtttccttttcttaccagcctggccccagcctagcttttcagcctcattttaacccctccccaacatgttatttatgctccctactccagacaactaggacatccctgaattctgtatgttcatgcctctgcctgggctcggctttctttgcctggaaacctcccagtcaacttgggaacctgtttgtcattttaagtcctgatcacatgttacttcctttgtgaagccttcctccagcccctgtccccaacaagattactggctttccattatgtttcttttttcttttcttttttttttttagtttggcatgacagacacatataaattttattatgatttaatcattatttctatccttttccttgaacaaagtctataaaagaattttagttgtatttttccaggtagttggattttttaaaaaacattttgcctctatcaaaatacttcaggaatacatttttagcagtcatattaagcatcacagacacattatcaacctttacttagatttagccatatattttattggtttctttgctcaactgcttacttttcaactgttttctcatttttctgtttctcctccatcttcctttctcttccccctactccttcaccatcttcgtccttaggtaattttagtttgccctcacatctgcataattggtaaagtatagaattctaggtgaaaaatctttttccctagaaactatgtaaacggtgtttcactgccttctgtcatttggtgtgaagttactaatcattatgtttctatagcacttagtttgcgctgctataaagtgccatggactgggtggcatttagttctcacagttctggaggctgggaaatccaagatcaagttcttatgtcaaatgattttttaataagttagtttattttgctataatctcatcttttgaattttttgttccttccaggtgtctggaactggattacagtttcttctgattgaacgcagcctttgaatactgcctggcctatcgcgaatacatgtgtgtgcagttattgttttctctgtagggtcataattgctttgccaggaccccatgccttttaagaacattggctctaccagcttgcctccatactatatgagctgtcatgttcttccttgttttcaatgcaaaactcctatgtaatttgtccccagtgttgctaggcctaaactaggggctagacaacatcccagcgttcacagaggatggtaggcactgtgcttggctttttacataaagtgtctcatttaatttgaacaacaccctgcagaggtaggtatacttatctccattttacagatgaggtaactgaagcccagagattttaagtcagtcacttgcctgaggttaattgtgataaaaccaagatttgaatccagatcttcccaacatcaaaatctgttttctcctagggatgctatagatagactgggttttctcaagaattttcagagaatttatcgtgtttctggtgaatggtgttaaagagcctctttctgattacagccctgccttggacaagacgcagctgaatctctaagtgatgctactgccactaccaccccagagctccaaacctgtgcctaagaaatctcagtccagcaaaattgtgcccagtcatcatgacccatctgaaaaggttagagcaagctgtctttcccaacaatatctttggtagtctcttcctgtgttggctcagtacctatcctcacctgtgagtcttttgaaatatgtctggtttaacctgagaaagtggggaggggtggcagcccttgtattggagaatgccagcaaattagaacttggggagaaagtatggactcttcattcccataaatgcagggctcaaatgaaggccaccctccataaccctcaaaactgaacaacactcagtcctcattaatgatcatgtctatattcttactttctctgagaagctccaagcaccttgctgaaagactggtacattctggggagagtatgaagattatatcagcacatatattattatgctttttatagctattaaatttgaagaatgggtatattttgactctgctgttttgactttattgatagtttgatgttctaaccttaggatattctgtgttcatcatcatacatattttaatcagaattatactagcactgatgaattggcatcaagagagtatttcctggagcaaaacatcattaggtgaatttaatttccttgattggttttctctgagcacagataaacattttctaatcttgcttattttactaaaatgattttcagcgaggtgccaaattttttcctatgtaaatttttcgagaaagatttgatatattgatcagatttttgtcaacatcaaattttcggattagtgttctgccattgtaacttttctttagtggcaattatttttccaaaaccaactttcttggagtacattttgcaaatctaagttttattgagttcagtttcagctataattttatttggggtcaattatttctatcagtaatattaaataggaattggataacagtttatttcttagctaatttctgagaaaataatgtttcatttttggctaatttctagtgggattatttatcatcagctagatgaaagactaatagcttacttatgtcttggcttaatcaattagaaaatggaagtaattcttctcagcttgttctgttttgttttgagatggagtcttgctcagtcacccaggctggagtgcagtggcacgatctcggctcactgcaacctccaccttccgggtttaagcaattccctgccttagcatcctgagtagctaggattacaggcgcctgccaccatgcccggctaatttttgtatttttagtagagacggggtttcaccatcttggccaggctggtcttgaactcctgacctcgtgatccacccgcctcggcctcccaaagtgctgggattgggattacaggcctgagccacagtgcctggccctcagttcggttttttttttttttttttggttgttgttgttgttgtttgtttgtttgttttttttgagacgtagtcttgctctgtcaccaggctggagtgcagtgacacgatctcggctcactgcaacctctgcctcccaggttcaagcaattctcctgcctcagccttctgagtagctgggactacaggcatgcgccaccgcgcccagctaatttttgtatttttgatagagacggggtttccccgtgttggcccgaacggtctcaatcacttgacctcatgatccatccgcctcagcctcccaaagtgctgggattacaggcgtgagccgccgcgtcgggctccagctcttttaagattgctctctctgctggattggtttattgtgtcatgaatccaattctggtaacttactgtgccatgtattaagtgttaatggtacagctggagaacagagcaaatggtctgatcccagtgtcctgcttcacattataacagctctctgacacaggtagggcgggtttgttttcagaatttcataagggcagtctgagacttaggagatttttaccacataaagttgttagagggtagaagactcctatagtgtggtttgccctaacctctaaccctatagagatggtcttactcatttgggaatggggtaaggcaagcacagacacagaatatgtgggaaaaaagccccttctgctttaaaatattcatcccccttcccttccccggcccctcctttatatatactaacaatcagagattaatctggattactaaactttgtttttaatataaaattttccttgtgaggtttacaatcatatcagactacattattttaaatactatttctgcccatttacagttcatacgaacttttaaaaaacatgtattgtcttatttaatcttcaaggactgtaaggcaagttatccagctttactgataagaaaattgaggattagagattaagttacttgtccaaggtcaacagttagtaaagagctgatcctggagcagtatctagatgtgtgtgctattatccttactggtaatgtcttttaaaacaggtccccaacccctgggccatggagcagtatctagatgtgtgtgctattatccttactggtaatgtcttttaaaacgggtccccaacccctgggccatggaccagtactagtctgtggcctgttaggaacccaactgtacagcaggaggtgagcagtgagtgagaaaagcttcatcggtatttatagccactccccatcgctcatattacttcctgagctccacctcctgtcagatcagcagtggcattagattctcatagaagcatgaaccctattgtgaactgctcatgcgagggatcaaggttgcgcgctccttatgagaatctaatgccttatgatctgtcactgtctcccatttcccccagatgggactatctagttgcaggaaaacaagctcagggctcccactgattctacattatggcgagttatataattatttcattatatattacaatgtaataataaatgtgcacaataaatgtaatgtgcttgaatcatcccaaaaccagcccaccccagtgtccgtggaaaatttgtcttccatgaaaccagtccctggtgccaaaaaggttagggaccgctgttttaaaagctgcttaacataagagacccttagatatttgttaaattattaaactgatctacctgaaaaagctgcttaacataagagacacttagatacttgttaaattattaaactgatctacctgaaacatctatattaaaggaatgactaggaatggtaggggtggtagtggtctaccttggataggataaccgtaagtatgagagaagtaagaggagaaatgagctttactgagctacactttgctcattttgtgagttacactgaaggtcatcttgcctccttgtagacgtaccccattaacaatgtctaccacctttagggacttaataaacagctctgagtgccataatttccttttgttatagtttattggggtttattatatgcatcctcagttactctgaggttctggagttcccctgagccctaaagaggacccaaagtccctgaagagactgttcacaattggatatactcatttacctcttttacttttttagacgggggagaattgccaaacgaagatatctccatcttcacttcaggagtctccatcttcacttcagggagcactcaaaaagagatcagcttttgaagatctcactaatgtgagtatgctagtccaatcctttgctatggttttgcataaggcttagacatgctgtttcttgagggacctttccactttaccagaccctctctggaatcttgacagcaaattttatttgggaccaatgacccagtttcagaaactgcaggggctctgttcctggcacataccatctgaaacaattggtggagttctctggaagcagcagacagtgattatcagatatgaaattgcagataactatgagaactatggaattttgcatttagataaagtccagaggtgactgcccaggccttcgaggtaagtattttagtggaatcattgtagtccagtgcagtgtttatcaattcacacattatggacattttgagcaggacaatttttctgttgtgtaggactgatctcaactagcacccctcgtcctcaggcattaaattccaccagcagcccagtcatagtgataatcaaaaatgcctccagatacacagaactgttgagaaccatagttccaagatcgagtctttatgaagatctagaaattcaattttggctagaattctctcaagtaacctcccttctggtattattaaggtaccagtaaaaatcagaattaatagaatgttgttaattgaatatagaatcaggccaaaggcaatctttgtcttagaaaataataataactggtacacttactgggtgcttaccatgtgtcaggcactatgctaagcatgttatcctgcatcagctcacttaatcctcatgtaatcctatgaggtagatactataatatcttctttatagatgaggacttcaccaatgttggttttgaagtctgtattatctaggctatagataatcctggtgaactattcttgccctgcattatgtagtatacttatgtagctaccagaatacttgtatctactaaatagtgttttactcccttgggcataattggataagcattggtaaggttctttcctttagatcgctgctctttagattctgtatggccacctttctgcaaatacaatctcttccctatacagattacaacatggttttttaagttacagctttctgcataatttcagatttactatcaattggtagaaagagccccttcccacacacacacttgtaaggttagattaatttcctgacttatttaaccatggatacagaatttggctgaaataaggtagccacaaatcaggagcagatgcagcctatcttagtgtaacttgccttggcccctccaagtccctgatgggagtacagtgacactgtgcaaggaaagtgtctaagtccatgtgggcaattatcacaaaacaccttagactgggcaacttaaaaacaacagaaagttattgctcacagttctggaggctgaaaagtccaagatcaaggtgctggcagatttggtatctggtgagggcccgttcctcatggatgacatcttttgcctgtgccctcatgtggtggaagaggcaaacaagcttcctcgggcctcttttataagggcactaatcccattcacaagggctgtgctctcatgacttaatcacttctcaaaaggcctatctcttaatagcatcacattggagattaggtttcaacataatgaatttcaaagggacacaaatattcagatcacagcagtaaagtatcacagcgcatgagaaactttcttgtgacatctcagtcccttttttcatgagtttatcttaccattcagaaagaacagatatacatgaagtgtatcaataatgggaaatccatgcaggtatctaggaccctcctgattctccagctgaattgagcatctgtttggccatatccccatggggttagggggcaggggagcaagggatctctgagcagagtctctgcttctagctctctggctgctcagaaagcccatttaccgtttgcgctcaagttctgaagatttaccttggttaccttgaatggtctttggtgccttccagagacagttccatcattacaatgtacctaagccattcctagggttgggcattactgcagatatctgagctcatctatttgacagttgagggctcctttctctctgggttttggaggttccctatatgataatttgcttcttacagtcagtattattaggtctccatgtcttcatccctgtgttcttctcaacatttgccacagtgagatcctggcctgccaaaaagagttaatctgttttaattagttaatctgctgtgagtttttcttttcctctgccttatcatttctagcatgggaaggacttatgatatttaagaactggtgctaagccagtagacaaggagatagggcctatatccatgtttgcctaaatggttttgcgtaagtaggactttcatttatttttatttatatatgttattttatttattttttttgagataaagtcttgctcttctgcccaagctggcatgatcacagctcactgcagcctcagcctcctgaatagctgggactacaggtgattgccaccatgcccagctaatttatgtattctttttgtagagatgggattttgccatgttgcccaggctggtcttgaactcctaggctcaagcaatcctcctgcctcgacctcccaaagtgctgcaattataggtgtgagccaccacaccaaaccttcacttctattttcctattttatggtgaaagaattatggggaagtacaagtaaaggtcccctggagcttaaacttgaaaatatcagtgctttgtacctgtatgtatggcaagtagagagtttcatcttgggagttatgatctccacgtctttcttgccatgaatgcacctcttttcccattctgaatcttgattgtacatataaggagtttgcaaaactttaggtgaagttaaaatggtgactgtgccaagctctttgaaaagcagaggtagatgacttgaggtcctaagaaagagtttcctattggactgtagttgtttattatgatctgatgatacaaagacatacttttttttctacatttaacttggaaataacttcaaatttatgaagtgttgcaaaaatgaaaattgtacaaagaacaccagtataccctatagtagattacttattgttgacattttgtcccacgtgctttctcatttgcttgtatatgtcatggtccctttacccgtaagtacagtgtgtatttcctaagaatagggaagttgtcttatataaccacaatatacttatcaattttctaaatttacattgatatagcagttttgtgtaatcaatcatctatattccaattttgtcagttgaccttataacaacctttatagcacgttttcccctccagtaaaggatccaggctaggatcatgtatttacttgtctttttagcctcttaacctggaacatttccatagcctttttttttaatgacgttgccatttttgaggatgcagtcccacccaactccccactttgtaaaatagaaaagtcctcattttgtttttgtctaatgtttgcttgtgactagattgatacattcttggctaggatactgtgtaggttatgttcttgctatccttctcaaagtatatctggaggcacaggatgtctgtctttcattgatgatgttaattttgatcacctgttcaagatgttgcctggtttttgtactgtatcattattgtttatctttttctcttgcaactagtaaggaatctgtaggacatactgtacaagcatgagccttcccttctccactgtttattatcagtatggactcctgagtccatattttccagaggtttactgttcattattgtactttattttggtgctcaaattgccccatctttggccagttaggagcaccttcaatctcactaacgtgtccttgtgacacactctcataattttttgagcattttctttccagcttaaaaagatgttccagactcatcttatgtctcctttgtccaagccctggagtcaaacatttctccagagttctggttccctttaatggggagtgatattagataccaagatattgatgctagatgtgctattaggatgtctgctttttctgcccattctgcagacagagctaggaaatatctgtatttttatatacacaaatgtgtacttatacatacgtctgtatatacaaatatatgtgtataactggttcagtcttgggagggtgtatgtgtccaggaatttatccatttcttctagattttctagtttatgtgcatagaggtgtttatagtattctctgatggttgtttgtatttctgtggggtcatggtgatatcccccttatttctgactgtgtctattttattcttctctcttttcttattagtctagctaacagtctgtctgttttattaatttttttcaaaaagccagctcctggatttgttgattttttttaaggtttttttgtgtctctctctccttcacttccactcaaattttgattacttcttgtcttttgctagctttggggtttgtttgctcttggttctctagttcttttagtcatgatgttaggttgtctatttgagatctttctagctttttgatgtgggcatttagtatatgtacacacatatacctatttaggaaatcatgaattcatgcagcttcaatttcaatacataaaattatttcttagattcactagtccttatttgtatgttctatattgagaaccctggctcccaagaacatcaacacatttacttaatactgtaatacagctaaaagagtttcaaaatggcttcatccaaaccactgtaataaacaaacctactaaaaagagttccagatttattagcaatatctacaacctcctgcagacctatcctaattgaggatgtatactttgaaggtggtagtcaaatactatttataagtgacttggattggttatttctggtcttttattctgctttattttttcctttaatgtagttatggtacttatttgaaatataattaggttcatttgtgtcatttaattttttaatttttaaaacttttttgagacagggtcttgctctgttgcccagtctggagtacagtagcgtggttgaagctcactgtagtctcaacctcccggactcaagcaatcctcttacctcattccccccaagtagctgggaccataggcatgtgccaccacaccgagctattttttttattatttttttgtagtgacagggtctccctatgttgcccaggctggtcttgaactcctgggctcaagtgatcctcccaccatggcctctcaaagtgctgggactgcaggcaagagccactgtgactagcctgtttgtttcattttaaagatataactttaagtgtatttttactgacattattaacagtcccatgatctttcctactgtttaatagtgttagtcaggattagagtctgtgtggaactccccaaagccctgagttaaataaatgccacttagtgagatgggatagatatatcacaggtagtatgtagtgttagaggtatatcctgaagaggcacacccagacagcaaagtcaatcatactgccttttttcccctctgaaaatcttatgaggtcaaagtggagtatgatgttaacacggcatattttcagttatgggccagctagtaggcctggcatagagcacagaactacatcctgtatctcttggaaacacatagggctgctagttagccaacacataccagtactactgcactggttgtttgatgctagcttccactgtgattggttggcccactgccatactggttgtgagatgtttggattatcactcctgggaacacccaaccaacttatgtgggtcaggactttcctatgagagccaccttttaggtaatttgtggttttcttcattttcttgcctccttcttcccctgccccccaacccacctttttttttgcaggcttctcaatgtcaacctgtccagcccaagaaagaagccaataaagagtttgtaaaagttgtttccaagaagataaacaggaacacacatgctcttggactggccaaaaagaataagcggaatctaaaatggtgagtgaaaggggactcagatggcattattttagatggtagagtatgtgacatccttttgtccccattgagaacatatttagcaagccacaatggtgactaccacattaaccctgggtgctgaggtgggctcagctgtggttgctgaagagttaaaaaaagcctcttctgtctctcctctttcattacgtgtgtgcatattgaaagagctcttgtcattggaaaatttgccaaaagaccttgtgctcatcttttcctgtcttttagtaattcagtacctgtttgagctagtctgtgctttatagtgtggagacaacttaactttccagggattctcagcagctgactggtagcttgccagtcagcttattccattagaagctttacgggaggtttgtcccatgttactggagataaattactatctccctagagcaaaaacatgtggttttcagctgttacaggtaccgttcacaggttctacaagtacagatgcacattcccatttaggattggaaaaataatttacctctaggaagactttatcccctcctcattccggtgggaattattcttcagggactaactaatctacatctgaatagattagatagctggctattacagggctaaagtcaatcatgttgccttattcccctctgaaaatcttatgaggtcaaggtggagtgatgttaacacagcatcttttcagttatttgctagccagaaggcctggtatagagcacagaactacatcctgtatctcttggaaacatgtagggctgctatttagccaacacataccagtactattgtactggttgtttgatgctagcttccactgtgattggttggtgcggtgccatactggttgtgagatgtttggattatcactcctgggaacaccaaagggtaagctaaaaagactgggtaactctagaaaataacacgcacagtccacaggatattgtgctaattacccagcagaaagaagattagcatttagccttacttggtttcctgctgaaatggaattctggagtttgcatgcatattttgacctcaattctctgcgttattttcttttgaatttctttcatcattctgactttatttttttatgtttctttgtttttttattattattattattatactttaagttttaggatacatgtgcacaacgtgcaggtttgttacatatgtacacatgtgccatgttggtgtgctgcacccattaactcatttagcattaggtatatctcctaatgctatccctcccctctcccccgaccccacaacagtccccagtgtgtgatgttccccttcctgtgtccatgtgttctcattgttcaattcccacctatgagtgagaacatgcggtgtttggttttttgtccttgcgatagtttgctgagaatgaaggtttccagcttcatccatgtccctacaaaggacatgaactcatcattttttatggctgcatagtattccatggtgtatatgtgccacattttcttaatccagtctatcattgttggacatttggcttggttccaagtctttgctattgtgaatagtgctgcaataaacatacatgtgcatgtgtctttatagcagcatgatttctaatcctttgggtatatacccagtaatgggatggctgggtcaaatggtatttctagttctagatccctgaggaatcgccacactgacttccacaatggttgaacgagtttccagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgttttttggctgcataaatgtcttcttttcagaaatgtctgttcatatccttcacccactttttgatggggttgtttgcttttttcttgtaaatttgtttgagttcattgtagattctggatattagccctttgtcagatgagtaggttgcaaaaattttctcccattctgtaggtttcctgttcactctgatggtggtttcttttgctgtgcagaagctctttagtttaattagatcccatttgtcaattttggcttctgttgccattgcttttggtgttttagacatgaaatccttgcccatgcctatgtcctgaatggtattgcctaggttttcttctagggtttttatggttttaggtctaacatttaagtctttaatccatcttgaattaatttttgtataaggtgaaaggaagggatccagtttcagctttctacatatggctagccagttttcccagcaccatttattaaatagggaatcctttccccattgcttgtttttgtcaggtttgtcaaagatcagatagttgttgatgtgtggtattatttctgagggctctgttctgttccattggtctatatctctgttttggtaccagtaccatgctgttttggttactatagccttgtagtatagtttgaagtcaggtagcgtgatgcctccagctttgttcttttggcttaggattgacttgtcaatgcgggctcttttttggttccatatgaactttaaagtagtttttttccaattctgtgaagaaagtcattggtagcttgatggggatggcattgaatctctaaattaccttggacagtatggccattttcacaatattgattcttcctacccatgagcatggaatgttcttccatttgtttgtatcctcttttatttcattgagcagtggtttgtagttcttcttgaaaaggtccttcacatcccttgtaagttggattcctaggtattttattctctttgaagcaattgtgaatgggagttcactcatgatttggctctctgtttgtctgttattggtgtataagaatacttgtgatttttgcacatggattttgtatcctgagaatttgctgaagttgcttattagcttaaggagattttgggctgagacaatggggttttctagatatacaatcatgtcatctgcaaacagggacaatttgacttcctcttttcctaattgaatgccctttatttccttctgctgcctgattgccctggccagaacttccaacactatgttgaataggagtggtgagagagggcatccctgtcttgtgccagttttcaaagggaatgcttccagtttttgtccattcagtatgatattggctgtgggtttgtcacagatatctcttattattttgagatacgtcccatcaatacctaatttattgagagtttttagcatgaagggttgttgaattttgtcaaaggccttttctgcatctattgagataatcatgtggtttttgtctttggttctgtttaaatgctggattacgtttattgattttcatatgttgaaccagccttgcatcccagggatgaagcccacttgatcatggtggataagctttttgctgtgctgctggattccttttgccagtattttattgaggatttttgcatcgatgttcatcaaagatattggtctaaaattctctttttttgttgtgtctctgccaggctttggtatcagaatgatgctggcctcataaaatgagttagggaggattccctctttttctattgattggaatagtttcagaaggaatggtaccagctcctccttgtacctctggtagaattcggctgtgaatccatctggtcctggactttttttggttggtaagctattaattattgcctcaatttcagagtctgttatttgtctattcagagattcaacttcttcctgatttagtcttgggagagtgtatgtgtcgaaaaatttatccatttcttctagaatttctagtttatttgtgtagaggtgtttatagtattctctgatggtagtttgtatttctgtgggatcggtggtgatatcccctttgtcattttttattgcgtctatttgattcttctctgttttcttctttattattcttgctagcggtctatcaattttgttgatcttttcaaaaaaccagctcctggattcattgattttttgaagggatttttgtgtctctattgccttcatttctgctctgatcttggttgtttcttgccttctgctagcttttgaatgtgtttgctcttacttctctagttcttttaattgtgatgttagggtgtccattttagatctttcctgctttctcttgcgggcatttagtgctataaatttccctctacacactgctttgaatgtgtcccatagattctggtatgttgtgtctttgttctcgttggtttcaaagaacatctttatttctgccttaattttgctatttacccagtagtcattcaggagcaggttgttcagtttccatgtagttgaacggttttgagtgagtttcttaatcctgagttctagtttgattgcactgtggtctgagagacagtttgttatagtttctgttctttaccatttgctgaggagtgctttacttccaactatgtggtcaattttggaataggtgtggtgtggtgctgaaaagaatatatattctgttgattttgggtggagagttctgtagatgtctactagatccacttggtgcagagctgagttcaattcctggatatccttgttaactttctgtctcattgatctgtctaatgttgacagtggggtgttaaagtctcccattattattgtgtgggagtctaagtctctttgtaggtcactaaggacttgctttatgaatctgagtcctcctgtattgggtgcatatatatttaggatagttagttcttcttgttgaattgatccctttaccattatgtaatggccttctttgtctcttttgatctttgttggtttaaagtctgttttatgagagactaggattgcaacccctgcctttttttgttttccatttgcttggtagatcttcctccatccctttattttgagcctgtgtgtatctctgcccatgagatgggtttcctgaatagagcacactgatgggtattgactctttatccactttgccagtctgtgccttttaattggagcatttaccccatttacatttaaggttagtattgttatgtgtgaatttgatcctgtcattatgatgttagttggttattttgctcattagttggtgcagtttcttcctatccttgacggtctttacaatttggcatgtttttgcagtggctggtaccggttgttcctttccatgtttagtgcttccttcaggagctcttttagggcaggcctggtggtgacaaaatctctcagcatttgcttgtctgtaaaggattttatttctcctttgcttatgaagcttagtttgggtggatatgaaattctgggttgaaaattcttttctttaagaatgttgaatattggcccccactctcttccggcttgtagagtttctgccgagagatctgctgtaagtctgatgggcttccctttgtgggtaacccgacctttctctctggctgcccttaacattttttccttcatttcaactttggtgaatcttacaataatgtgtcttggagttgctcttctcgaggagtatctttgtggcgttctctgtatttcctgaatttgaatgttggcctgccttgctagattggggaagttctcctggataatatcctgcagagtgttttccatcttggttccattctccctgtcactttcaggtacagcaattaggcgtagatttggtcttttcacatagtcccatatttcttggaggctttgttcatttctttgtattctttttctctaaacttctcttcatgcttcatttcattcatttcgtcttccgttgctgataccctttcttccagttgatcgccttgtttactgaggcttgtgcattcgtcacgtagttctcgtgccatggttttcagctccatcaggtcctttaaggacttctctgcattggttattctagttagccattcgtctattttttttttcaaagtttttaacttctttgccattggttcggacttcctcctttagctcagagtagtttgatcttctgaggccttcttctctcaactcgtcaaagtcattctccatccagctttgttctgttgctggtgaggagctgtgttcctttggaggaggagaggcgctctgatttttagagtttccagtttttctgctctgttttttccccatctttgtggttttatctgcctttggtctttggtgatggtgatgtacagatgggtttttggtgtggatgtcctttctgtttgttagttttccttctaacagtcaggaccctcagctgcaggtctgttggagtttgctggaggtccactccagaccctgtttgcctgggtatcagcagcggtggctgcagaacagcagatattggtgaaccgcaaatgttgctgcctgattgttcctctggaagttttgtctcagaggagtacctggccgtgtgaggtgtcagtccgcccctacttgggggtgcctcccagttaggctactcaggggtcagggacccacttgatgaggcagtctgcccgttctcagatctcaagctgcgtgctgggagaaccactactctcttcaaagctgtcagacagggacatttaagtctgcagaggttattgctatcttttgtttgtctgtgccctgcccccagaggtggagcctacagaggcaggcaggcctccttgagctgtgatgggctccacccagttcgagcttcctggctgctttgcttacctactcaagcctgggcaatggcaggtgcccctcccccaggcttgctgctgccttgcagtttgatctcagactgctgtgctagcaataagcgaggctctgtgggcataggaccctccgagccatgtgcgggatataatctcctggtgtgccatttgttaagcctgttggaaaagcgcagtattagggtgggagtgaccggattttccaggtgccatctgtcacccctttctttgactaggaaagggaattccctgaccccttgcacttcctgggtgaggtgatgcttcaccctgcttcaactcgtgcatggtgcgctgcacccactgtcctgcacccactgtctggcactccccagtgaggtgaatctggtacctcagttggaaatgcagaaatcacccgtcttctgcgttgctcatgctgggagctgtagactggagctgttcctatttggctatcttgtctccaccatcattctgactttagcagggcaatcctcacaaatgccataaacattcttctcttcactcagggttcagtggaaaggaccctaataatagtaggaaaactagtaatagctgccatttactgagagctcactgtgatcacagaagtataatcattaagtctttattttttttagtaacagctttattgagatataatttgcataccaaacagttcacccatttaaagtatacaattcaatggtatttagtatattcacagttatacagccatgacaatcaattttaggacattttcattaactccaaagaaaccctgtacctttggttatcacctctcaatacccccaacctgcccagctttgggcaaccactaatcttactttctatatagatttccctattctggatgtttcatataaatggaattagacaatgtgtggtcttttgtgtctagcttctttcacttagcatgtttttgaggttatccgtgtcatagcaggttgtcagtacttcatttctttttattgccaagtaatatttcattgcatatatacaacacatttggtttacccatctatcagttgatagatatttgcattgtttctaccttttggttattgtgaatagtgctgctattgaatatttgtgtatacctttttgtttgaaaacttgttttcaattcttttgtgtatatacttaggagtgtggttgctgggtcatatggtaattctgtgctccatgtattgaggaactgccaagctgtattccatagtggctacgccattttacatttcctccagcagtgtatttactggaggaaatgtaaaatggtatagccactgtggaatggtggcagtgttgtgtttttgtttttgtttttccttgagacagagtctcactctgtcacccaggctagaaggaaatggtgcaatcttggctcactgcaaactctgcctcctggattccagtggttctcgtgcctcagcctcctgagtagctgggattacaggtgcccacaaccacctccggctaatttttatatttttagtggagatggggttttgccacattggccaggctggtctcaaactcctgacctcaggtgatctgcctgcctcggcctcccaaagtgctgggattacaggagtgagccaccatgcccagctggcagtgttttttttttttttaaacacccatcatggtgggtgtgaagtggtatctcattgtggtttttaggtttgcatttctctgactaatgatgttgagcatcatttatgtacttattggctatttggtacttctttggaggaatgtctgtttggatcttttgcccatttttttatgcttttatttcttaattttttaattttatttttaattgacatataataatcgtaaataattgttggtctttgtattgttgagttgtaagagttctttatatattttagatacaagtccctgatcagatacgagttgcaaatattttcatccattttttgggttatcttttcactttgttgatgatgtcctttgaagtacagaaatttttaattctgaagaagtctaatttgttttttcttttgttgtttatgattttgatgtcatgcctaagaaaccactgccaaatcccaggttaagaaaatttacacctgttttcttctaagaattttaaagttttagctcttaacttagggttttgatctattttcagttaatttttattggtggtgtgtattaggagccttaacttcattgttttgagtgtggatgtccagtttttccagcactatttgttgagaaaactaacctttcttaattgtcttggcacccttcttggaaatcagttgaccataaatgtgtttatatatggactctcaattttattccatttatctgtatgtctctcattaactatcattatgccagtaccatattgtcttgattattgcagcttcatgttgtgttttgaaattgggaagtgtgactcctccaaattttgttcttctttttcaagattgttttgactattttgggttccttgcaattctatataaattttagaatcagcttgtcacaactatctgatctttgacaaacctgacaaaaacaagaaatggggaaatgattccctatttaataaatggtgctgggaaaactggctagccatatgtagaaagctgaaactggatcccttccttacaccttatacaaaaattaattcaagatggattaaagacttaaatgttagacctgaaaccatacaaatcctagaagaaaacctaggcagtaccattcaggacataggcatgggcaaggacttcatgtctaaaacaccaaaagcaatggcaaccaaagccaaaattgacaaatgggatctaattaaactaaaagagctcctgcacagcaaaagaaactaccgtcagagtgaacaggcaacctagagaatgggagaaaatttttgcaatctactcatctgacaaagggctaatatccagaatctacaatgaactcaaacaaatttacaagaaaaaaacaaacaaccccatcaacaagtaggcgaaggatatgaacagacacttctcaaaagaagacatttatgcagccaaaagacacatgaaaaaatgctcattatcactggccatcagagaaatgcaaatcaaaaccataatgagataccatctcacaccagttagaatggcgatcattaaaaagtcaggaaacaacaggtgctggagaggatgtggagaaataggaacacttttacactgttggtgggactggaaactagttcaacccttgtggaagtcagtgtggcgattcctcagggatctagaactagaaataccatttgacccagccatcccattactgggtatatacccaaaggattagaaatcatgctgctataaagacacatgcacatatatatttattgcagcactattcacaatagcaaagacttggaaccaacccaagtgtccaacaatgatagactggattaagaaaatgtggcatatatacaccatggaatactatgcagccataaaaaatgatgagttcatgtcctttgtagggacatggatgaagctggaaaccactgttctcagcaaactatcgcaaggacaagaaaccaaacaccgcatgttctcactcataggtgggaattgaacaatgaaaacacatggacacaggaaggggaacatcacacaccggggactgttgtggggtcggggaagaggggagggatagcattaggagatatacctaatgttaaatgacgagttaatgggtgcagcacaccaacatggcacatgtgtacatacgtaactcacctgcacgttctgcacatgtaccctaaaacttaaagtatattaaaaaaaaagaatcagcttgtcaatttctacaaacaagctagctgggattcttgtacaaattgccttggatctgtggatcaacttgggaagtattgatatgggtttttttttctttctttcttttttttttttttttttttgacggagtcttgctctgccaccgaggctggagtgtggtggtgcaatcttggctcactctaacctccacctcccaggttcaagtgattctcatgcctcagccttcctgagtagctgggattacaggtgtgtggccaccacaccagctttttttttttttttttcgtatttttgtagagacatggtttcactatgttgggcaggctggtctcgaactcctgacctgaagtgatctgcctgcctcgactcccaaagtactgggattacaggcttgagctactgtgcccagcctgacatcttaacaatattaagttttctaattcatgaatatggatgtctatctatttagatatttagttttttgaatggttttttacagtttccagagtataagttttatgtttgttaaatttatttctaagcattttcttcttcttgatactattgtaaatggaattgtttacttaatttcattttcagattattcattgcaagtatacagaaagacatttgatttttgtatattgattttgtgtcctggaatcttgctgaagttgttcgttctaatagttttctgtgtgtattccttaggattttctctatataagatcatgtcatctgtgaatacagatatttttacttttccaaactggatgacttttatttagttttcttgcctacttgccctagctacaacctctagtataatgttgaatagaagtatcaagagttggacattcttgttttctccctgatcttagggggaaagtatcagtctttcaccatcaagtacgatgtttgctttgggtttttttgtagatgccctttatcaggttgaggaacctcctttctattccttgtttgttaagtgctttttatcatgaaagagggttagatttagtcaaatgattttcctggatcttttgagatgatcatgtcgtttttgttttctattctattaatgtgatgtagtatgcaaattgaattttgagtgttaaattaattttgcattcctggtataaattccacttgtttatggtgtataatccttttatatgttgctggatttggtttgcagtatttggctgaggatttttgcatctatattcataagaggtattggtctgtagttttctagtggtgtctgtctgttttcgttatcagagtaatactgacctcatataatgagttagaaacttcacattttttgtgtttctttgaagagttaatgaagaactggtattaattattgtttaaatgtttggatggaattgaagccatttgggcctggactttactttgtgagtagtttttgattattgatttgatatcttgttataggtctattcagattttctgttttcttcttgagtcagttttggtagtttgtgtcttcctaggaatttgtccatttcatctcaattatctaatttattgacattcaattgttcataacgtgcctttaagtgtttttgagcatactaatttgttgaatcttcacaataagcctatgaaggagatattatgatcctcattttataggtgaaaaaaactgaagcacagagagttaacttgcccaaggtcacccagtcagtaagttggaggagccaggatttgaatccaggcagtctagctccagaatgcatgttcttaccatagctagactatctaaagatcttctctaaaagttatcaggagggacctggaatctatctggtcaagcagaaccttttgaagcactttttttttcttaacaaatcagtggtttttcattctattcctggatttgtacagctatcaccactatctaattttagaactttttcaataccccccgtccactaaatccatacctattaggagttcttttcccttcctaatccccctttctactcctacccctgtcccagcctcaggaaaccactagtctactttctgctgtggatatacctctatgggtatgtccattttgcatatttcatattgaactaaatcatatgatatctggtctttagaaggtatttactcctgctcagattggtgattatatctgcctgaaattctctctcttcttattctgaactttagtctttctgtgattttgtctcactagattcatcactctaattgaatatacaatcctattcaaaacaaagctttgcatctggcacatgtgacaagtttctattttgagctttttattacctccattgggaaaacatctccttaatagtccagggtgaggggaatgtagttagattctaccaaagttaattaccagcccatctctctcattagccttcaaacaatgttaatttcaacctgaagtttaccagctgccttgggttgatagacaaagacaaatgcagctagtgaaggagactgatgtatgaacaagtaactcatacaatgtgataagtattataaaagcctttgtatataaggtaatgaagcatatataagaaagcataacatgaatttctatggaaaaattatagaaaagtgtaggtatctaggccatagaaactatacagtgtactacttaagttgattgaccatggtacctactgattttgtccctctaatctgtcttatggggttgaagccccttcccctttcatacctttagtaaatatagcaacaaaaggaaatggtaggtgaggattctaggaactacatttttcttacccagacattgtttccttcacaggcataagctggaagtcacaccagtagtagcctctactaccgtggtaccaaacattatggagaaaccactcattctagacatatccaccacctccaaaacacccaacactgaggaggcatctctcttcagaaagccattagttttaaaggaggaacccactattgaggatgaaacccttatcaataagtcattatctttaaaaaagtgctcaaatcatgaggaggtgtccttactggaaaagctacagcccctgcaggaggagagtgacagtgatgatgcgtttgttatagagccaatgacttttaagaagacacataaaactgaggaggcagccatcaccaagaagacattatccttaaagaagaagatgtgtgcaagtcagcggaagcagtcctgccaggaagagtcgttggctgtgcaggatgtcaatatggaagaggattccttctttatggagtcaatgagttttaagaagaagcctaaaactgaggagtcaatccccacccataagttatcatctttaaagaagaaatgtaccatttatgggaagatatgccactttaggaagccaccagtattgcagacaaccatctgtggagcaatgtcctccattaagaagcctaccactgagaaggagacacttttccaagagctatctgtattgcaagagaaacacaccactgagcatgagatgtccatcttgaagaaatcattggccttgcagaagaccaactttaaagaggattcccttgttaaggagtcgttagcctttaagaagaagcctagcactgaggaggcaatcatgatgccagtaatattgaaggagcagtgcatgactgaggggaagaggtcccgtctgaagccattagtattgcaggagatcacctctggagagaagtcgctcattatgaagccattgtccattaaagaaaagccatctactgagaaggagtccttttcccaggaaccatctgcattgcaaaagaagcacaccactcaggaggaggtttccatcttaaaggagccctcgtccttgctaaagtctccaactgaggagtcaccttttgatgaggctttggcttttacaaagaagtgtaccattgaggaggcaccccccaccaagaagcctttaattttaaagaggaagcatgccactcaggggacaatgtcccacttgaagaaaccactaatattacagaccacctctggagaaaagtcacttattaaggagccactgccctttaaagaagaaaaagtgtctttaaagaaaaagtgtaccacacaagagatgatgtccatctgtccagaactgttggactttcaggatatgattggtgaagataagaattctttctttatggagccaatgtcatttaggaagaaccctacaactgaggagacagtacttaccaagacatcgttgtctttacaggaaaagaaaattactcaggggaagatgtcccacttaaagaagccactggtcttgcagaagatcacttctgaggaggagtcattctataagaagctgttgccctttaagatgaaatctacaacggaagaaaagttcctctcccaggaaccatctgcattgaaagagaagcataccaccttgcaggaagtgtccctctcaaaagagtcattggccatccaagagaaggctaccactgaggaggaattctctcaggaactattttcattgcatgttaagcataccaacaaaagtgggtccctcttccaggaggctttggtcttgcaagagaagactgatgccgaagaggattccttgaagaacttgttggctttgcaggagaaaagcaccatggaagaagagtcccttatcaataagctattggctctgaaggaggagctttctgctgaggcagccacaaacatacagacacaattatctttaaagaagaagtccacttctcatggaaaagtgttcttcctgaagaagcagttggctttgaatgagaccatcaatgaagaggagttccttaataagcagccactggccttggaggggtatcccagcattgcggagggggagaccctcttcaagaagcttttggccatgcaggaggagcccagcattgagaaggaagctgtcctcaaggagcccactattgacacagaagctcactttaaggaacctttggccttgcaggaggagcccagcactgagaaggaggctgtcctcaaggagcccagtgttgacacagaagctcactttaaggaaactttggccttgcaggagaagcccagcattgagcaggaggccctctttaagcgacactcagctttgtgggagaagcccagcactgagaaggagaccatcttcaaggagtctttggacttgcaagagaagcccagcattaagaaagagaccctcctcaaaaagccattagccttgaagatgtctaccatcaatgaggcagtcctcttcgaagatatgatagctctgaatgagaaacccaccactgggaaggagttgtccttcaaggagccattagccttacaagagagtcccacctacaaggaagacacctttctcaaaacattgttggtcccccaagttggaaccagcccaaatgtgtctagcactgcccctgaatccataaccagcaagtccagcattgctaccatgaccagtgtgggcaaatctggtaccatcaatgaggcattcctcttcgaagatatgataactctgaatgagaaacccaccactgggaaggagttgtccttcaaggagccattggccttacaagagagtcccacctgcaaggaagacacctttctggaaacattcttgatcccccaaattggaaccagcccatatgtgtttagcaccacccctgaatccataacagagaagtccagcattgcaaccatgaccagcgtgggcaagtccaggaccaccaccgagtccagtgcatgtgaatctgcttctgataaacctgtctcaccacaggccaagggaacaccaaaggaggtattcatctccctttcttcttaaattagataaattgttctttgatatcctggaggtggctgctagcaaagttgtttttttttttttgtttttgttttttgttgttgttgttgtttttttgccttcctaagcagttgagccatatatagtaagttattgagagtatccctctacctagtgagagggtgatatttcttaggtttacttctggttttatttaatgataggtgatgcagaatcatctcttctcaccttttgtagcctgaggttacccatgatttgggatacatttcccaggttctttggcatttttctcttaagttggccttgtacaatctcttgacttcctgattggcacagtgatagatctaagcaatcagaaagtatttattccagtaatacccacaagagtctggactactgtgctatatacttgggctttgcaatagtggccaggtaatttcattcaggaaattgcctttcttagtaattgtaatttgcatcacggtgggctttggtaaaaaatgggcaaagttcataggagcatctcccaaggaaggtggtctttacgttgtaaatttgaataatgaagggatgatatttagcaagcaggaggagaaatgtcctttttgtagcaaaacatcctgggtaaaggtatagaaaggaggaaaagactaccaagatgaattgggccagatcaaagcattgacataattagggacctaagaagacaggtaacaaagctgaaataataaaataagaatgtccgtcttggagaatcttcagcttacccataaaaagggtcccttgttcctagggcagcgaaggtatatacaatgaagtctaggcatttcttgatccctggaccatatgaggattgcacagccaaggagtactgtgttatggcccaacatatacaaggcttgagacaccttagcagaagaagacagtggggagaaaggagtaatcattgatatgtatgtgctaagtcttccttggaataattctcataatatgtctttttggtgatttctaagcagataaccccacgggaagatattgatgaggacagcagtgatccaagtttcaacccaatgtatgccaaggaaatcttcagttacatgaaagagagagaggtatttaggttgcttgggttgggcaatgatttctagttttcatttcttcatcattccatccttcagtgtgcaagttgaaaggggtggtaataatgatgataaaaataataatagcaacaactaacatattggtagcttactgtgagttggacattgtactaacagatttgtagatattatcttaattctctcagtaacttcatgatggtaggtattattatctccctcttacagatagaggaaactgcccagagtcatgtaagtggtacatggtagagctgagatatgaactaaagtctgattgccttgaagaccataatcctgtacatctaattgctaagaagacagtcttagacacaaaaatggtcaagtagtctctgagtggctgttcttagagatctttttccttccctgtgcatgtttctggcattgtaggcaaaatcgtattctttgtttcatctctccaacctggtgaagttttctttctcctttgaaatctgccagtctcctttaccactaatattcatcaattccaaagtttcttctaactctctcaacagaacagatgggaccaagattatctaccaagcagaatttttagcaggtcatgtataagagggtgggaggatggaaacccacctacagatccacctatcctctttatagagagagtgcaattgattaactgattccaaagcccacactttttctggcatacctaagtaagggacatctttgttataataaaagtgtgagccttggttcagcagtatcagtttcacttgagattttgttagaaatgcagaaacctagccccatcccagaccttctaaatcagaatctgaagttttacatgatccccaagtagtgcatatgtatgttaaagtttgagaagcactgctctacatagcatggtattgtgctttagattgaattgcaaagaaagggcagaacctttttggcatttgtctacagctgtaggtgtgtttctgcccttatttccccctggattcttcaatatccactctgacacttgaatatcacgtgtctatttcccaaagcataactgcaacttgcctggaaaaggatactttgatctgcccctctctaataccagttgaaaacaaggagttagaactatgagggagaagttaattgttaagttacaatgttgaactataagaagagtttatttattaacatttctttctcatcaatgccaggaacagtttatacttacagattacatgaacaggcagattgaaatcaccagtgacatgagggccattcttgtggactggttggtggaggtgcaggtaagcctgacaactcctgccttaaggagctgctgttctctttctcattcagggctgccaggccaaaaacatggtaaaaatgtactgggtctatagagttgaataagctgtggttcctgccctcaaggagctcatgatttaggaggcaagataagatatgcagacaaataagtgtaatacaaagtagaatatactaagtgctctaagaatgtttcaaataagatactgtgagaactaattgaaaggagagactctttctagaaaaggcagtgacggtatggtcgttttatcattcttaaagtcttgtaaaagtatatctagtgatttggactggggtcgatgacaaagtctttcaaactttgagtggaatggataataggaaggacagtgtggcacaggacatggcaggtagctgtttgtccaaggtgagatattgagggaatactgctatgaatacttaattattattttatactaagataggagagcccagagtagtacatagcatatagtagggggtcagtaagtatttgttgaatgaatggaattgaaagaattgctatggagtttgcaaggaaacatacagcatggtcagtctacgctcagcagtcttagtatgtaattaggaagaaaagacaatatagttttatatcctttgttaagtatcagaggagtggttcaggctcattttggggtgacagaccaaggaattgtggtagacacagtatatctgagcatcagcaaaacatgaaaatgtctctcatcttatgaaaatggtagagaacagtaaatcaggtaagagtaaaatttgggtagatcttaaataagtgaaacagaacccaaagattgcttatcattgccaagctggaaagaaatttctagtgactgccattggactttgttctgcttaacattctcattagtaatgtaaatgagaacagagaagatgtattcattaaattcctggatggcaggaaactaggagtagggataggaaataaatggcttacagagaaaaaaatatctctgccagctggaatgatgaactaaatattttttatttaaagtttttgttattgcataaaaatgtacattatagcaaagtaagaaattataattacctgtgatcccacaaccccaaactgctgttctcatttgtttgcatatattatccccccatcttaagcagtggttatccattaggggtgcatctcagaatcagatgcccaggtcctatcccagacttatccaatcagaattgtggggatgtggcccaggcacacatatttttataaagctccacaagttatatcaatgtataccccttgaaagagaatctcagttctagaaaataccatattgtttttataaccttagttatatgtagtgcttttataactctttggttttttattttaaaataaccaaataacaataatgactttttggatataaagttccatgaaattttagcatttgtttggaaataatcaattcataagaaattgaaaaaaaggacaaagagagcctgtatacccttcaccctagtttatcccgaagatgacatctggcacaactatagtatagtgtcatggtcaggaaatggactttgttataatccacagaccttgtttagatttcagcagttttacatgcactcatttgggggtgtgtatagtctatttgatcacatttgtaaataaatatttagtctatttgttcacgtgtacattttgtaatcactaccacagttaaggtacagaactgttccatcgccacaaggatccctcatgccactttttgttagccacaaccatctccctcccctctccttcctgtccctgacaaattatttgttttccatctctataattttgtcatttcatgaatgttatataaatggaatcatacagtgtatagccttttgagcttgatgtttactactcaccgtaattcccttgagatccatccaagttgtgtgtatgaatagttcattcctttttgttgctaagtagtattccatggtacagatgtaccacggtaatatggtttggctatgtccacacccaaatcttatcttgaattatagctcccataatccccacgtgttgtgggagggacgcagtgggaggtaagtgcatcatgggggtgagtttttcccatattgttcttgtcatagtggatatgtctcacgagatcagatggttttataaaaggcagttctcctgcacacactctcttgcctgcctccgtgtaagatgtggctttgttcctccttcacctttttccatgattgtgaggcctccacagccatgtggagctgtgagttcgttaaacctcttttctttataaattacccagtctcaggtatttcttcatagatgtatgaaaatggactaatacacacggtgtgtttaaccattcacctattgaaggacatttgggttgttactagtttttggctattaaggataaaattactatgaatatttgcatacagcttttttgtgaatatagtttttatttctctgggattaatactgaagagtgtgacagttctgtgaatttttagcatatgtattgatttgtgtaactgccactatgattaggaaatagaacagtttgactacgccataaaaacttccttatgttatccgtttagagtcacacccaccttccacccctaactcctggaaaccactaatctattctctatctttgccttttcaagaatattgtataaatgtttgtgttatatgtaaccttatgagactggcttctttcattcagtatgatgcctttaagatttattcaagttgttgcagatatcattagttcattctttttattgctgagtggtattctatggttcggatatatcacagtttatccattctcctgtggaagggtatttagtttgtttccagtttttgatgactgtgaaaagaactgtacattaatgtacaggtttttatgtgaagatatgttttaatttctaatgtcagcacacaggagtgggatcattgggacatatggtaagtgtatgtttaacttaattagaaattgccacagagtggctgtacatcttgcattctcacctccaatgcatgagagttctggttgctctgcattcttgtcagcacttggttttgttagtactttattttaaccatctaataggtgtatagaggaatctcctcatagttttaatttttatttccttaagggttaataatgttgacaaccatacttgtcatgcatatatcctctttgatgaaatgtctattcaagtcttttgcccagttataaataggtagttcgtttccttagtgtcaagttacgagagttctttatgtattctggatacaaatcctttgttggatatgtgatttataaatatatcctctcagtctgtagtttttctttctcttaccagtgtctttcccagagcaaaagtttttaattttgatgaagtccagtttatcaatgccttctttatggattatacttacttctaaggactctttgcctaaacctaggtcaggaatattctgtctctctctctcatgtgtatgtgtgtgtgtgtatttaaatttatgtatgtatgtatgtatgtatgtatttatttatttatttatgagatggagttttgctcttgttgcccaggctggagtgcaatggtgtggtctcagcttactgcaacctccgcctcccaggttcaagcaattctcctgcctcagccttcccagtaactggaattacaggtgcccgccaccctgcctggctaatttttgtatttttagtagagatgaagtttcaccatgttggccaggctggtctcaaactcctgacctcaggtgatccgcctgcctcagcctcccaaagtgctgtgattacaggcgtgaggcactgtgcccgacttctttcctatattttatctcaaaggtttatagttttacatgttacattaaatctatagtccatttttagttaatttttgtataaggtgtgagatttaggtcaaggttctttttttgcatatgagtgtctaattgttctaatgccacgtgtgggaattaaaaactatactttcttcatggaattgtttttgcaccttgctaaaaacagtttctgtgggtctataccaatattctgtttcctttatctctgtgtctcttccttcaccaatatcacactgtctttatttctgtagttttatagttagtcttaaaactgggtattgtgatattttcaactctattcttaaaaaaaaaaaaaaaactggccaggaatggtggctcatgtctgtaatcccaacactttgggaggctgaggtgggtggatcatgaggtctggagttcgagactagcctgaccaacgtggtgaaacctccgtctctactaaaaatacaaaaattagccgggcatggtggcaggcacctgtaatcccagctactcaggaggctgaggcaggagaatcgcttgaacctgggaggcggaagttacagtaagccaagatcgggccactgcactccagcctgggcgatagagcgagactccatctcaaaacaacaacaacaacaacaaagcaaaaaacacctgttttagctattctagttcctttgcctttctatgtaaattttagaatcagattatatcttaaaaatatttctaggagtttgattggaattgaaatatattttgtgcagaaaagagttaaaataataggcctgatactgctatccctagaaaggtctgtttgcaaggttggcccttggctggtaatctggaaacttggccggtaagcagtccccacactgatataaaacttccccgaatgttaattgtggcttactgtgcttaaactctttatgcaaacagtgtggtttaggctgagcacctgctttccttttgggagtctggaacttcagaacatgctaggcacagagtgtttacttgaccagttcccaataaaattttgggcactgagtgatagtaagcttccctggtagacaacactttccatgtgttgtcacaactcattgctagaggaattaagtgcatcctgaagtgactactgacaggactcttggaagcttgcttgtggctttttccagattttgccccatgcttcttatccctttgctgattttgctttgtatcctttcactgaaataaatcatagtcatgagtatgactatatgctaagtcctatgagccatcctaggaaatcattgtgcttgaggtggtcttagggaaccccaatacacatctataggtgagttcagatagaattggcgcgttactatgttgaatcttccaacctatggtatgtctctccatttatttaaattttctttgatttatttttctcatcatatagatcctatacatgttttgttagatttataaaaaatattttcttctcttgaagctattgtaaattatgttttttaaatttagctttctatttatacattgccagtatgaaatatggttgatagttgtgtgttgaccttgtattctgtgactttgctaaaactcaggagttctttttttgtagatttcttggggttatctacatagataattgaatcatctgcaaatggggaccgttttatttcttcctttctaatctccatgctttttattttattttcatgttttattatactgcctgagacttccattatgatgttgatatagatgcagtaagagtggacagcattgccttactcctgatcttaggaggaaagcattgactttaactattagtgtgattttagctgtaggatttttgtaaacacctttgatcaggttgagaaagttactttctatttctagtttaatcctgcgtaatatatttttttatcatgaataaatgttgaactttgtcaaatgcttttttcctgcatctattgatttttttttgttttagcctaatatagtaagttaaatcaattgatcttcaaaaatgggagcaacgttatttttatattcctgagataaaccccattttgtcctggtatatttttctttttaggtattgctggatttgatttgctaatattttgttgaggatttttacatctatgtttatgatggatgtcgggatgttggtctgtagtgttctgattgggttttttgtttgtttgttttttgttctggtatcagaataatagtgatcttgtaaaataagttgggaattatccccaacccttctgttttctggaagggatgtgtagaattgatgttatttcttctttaaatgttggtagaatttgcaagcgaaaacattggagcctggagagtttttcccaaaaggttttcagtgaagaatatcatttctttaatatttataaggttatttaagttatctatttcatattgggtgacttttggtagtttgtggttttcaaggagttggtcccttccgtctaagctgtcaaatttatgtgcatagagtttttcatagtgttccctctttcattcctgatactggtaatttgtgtcttctcttgttttgtttatcagtcttgctagaggtttattaattttattcatctttccaaagagccagattttggtttcatccatttttctttatttttctgtttttagtattcttcatatctgctctaatttttataattttataatttttataattttataactatttaaaaaatagttttctttcttcttgcttatggtttaatttctttattatccatggtgattttctgtgtaataattctgttactgagagaggagtactgaagtcttcaactataattgtggatttgtctatttctaagttttgtcattttttgctttgtgttttttgaagttctgttgttaggaacatacacatttaggattattatatcttctttatatttatttctgactttttcttcatataacaatggttatatgattgcaatcatctttccagtcaaactgatgtatttctatatccattttatttgcagtatggtatttctcttctatcatacccatcctgctattaatggacatttaggttattttcaaatattgctctttgaaataaccctgtagtgaatatacataaatgtgcattttttaacaattttactattgtttctccggaccaaatgactaggaataggattattagatcaaaagatgcacatgaaaaatttttgtacatgttgacagctatccttctgaaatgtcatgaccatttatgcttttaccattactgaatgaaaatgcttattttcccataatcttatcaacaaaagaagttatattttttaccatctgataagtgaaaaattttaatgtgttattttagttagctgtacagaagcactggcattttaagtagtcaagtttatcagttcttataactttaagatttgtttcttgcttaggaaagtcattagtccagaattatataactatttctacaaaattttttctagaatatttatagtttcatttctacttttaaatccttagtctattgggtgtcagaatctaaacaactttctccaatgattatccagttattctaacaccatttattttcattatacactggtttgaaatgacacctttatcataatacttcagtttgtagtctttccaattctcttccattgatctatttgtctactctaacatcagtagtatactgtttttattatatattatttgtctactctaacatcagtagcatgctgttttattattatattattatggctttgtaatacatttattgcctctttactcatcttttataaaatattcctggttgttcttgcacattaattcttccaggtgagctgtagaataattttgtcgagttttcaaaaatagcccattaggattaattcaggaaaaattcacagactttataatgtcgaacttactaagccagttatgttgtgtctatttacttcccaggtcttttacaatttcaatttttaaaaaattttcttcatattggtctcactaacttaaaaatgtttttcttgagtattgagaattttttaaatgttatgagtgttatcctttttcccttttaaaatttattgctagttttttttttttggtccatatgaactttaaagaagttcatatggaaccaaaaaaagagcccacattgccaagtcaatcataagccaaaagaacaaagctggaggcatcatgctacctgacttcagactatactacaaggccacagtaaccaaaacagcatggtactggtaccaaaacagagatatagaccaatggaacagaacagagccctcagaaataataccacacatctaccaccatctgatctttgacaaacctgacaaaaacaagcaatggggaaaggattccctatttaataaatggtgctgagaaaactggctagccatatgtagaaagctgaaactggatcccttccttataccttatacaaaaattaattcaagatggattaaagacttacatgttagacctaaaaccataaaaactctagaagaaaacctaggcaataccattcaggacataggcatgggcaaggacttcatgtctaaaacaccaaaagcaatggcaacaaaagtaaaaattgacaaatgggatctaattaaactaaagagcttctgcacagcaaaagaaactaccatcagagtgaacaggaaacctatagaatgggagaaaatttttgcaatctactcatctgacaaagggctaatatccagaatctacaaataactcaaacaaatttacaagaagaaaacaaccccatcaaaaagcgggcaaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtaggactgtaaactggttcaaccattgtggaagacagtgtggcgattcctcagggatctagaactagaaataccatttgacccagccatcccattactgggtatacacccaaaggattagaaatcatgctgctataaagacacatgcacatgtatgtttattgcagcactattcacattagcaaagacttggaaccaagccaaatgtccaacaatgatagactggattaagaaaatgtggcacatatacaccatggaatactatgcagccataaaaaatgatgagttcatgtcctttgtagggacatggatgaagctggaaaccatcgttctcagcaaactatcgcaaggacaaaaaaccaaacaccgcatgttctcactcaggtgggagttgaacaatgagaacacatggacacaggaaggggaacatcacacactggggcctgttgtggggtagggggaggggggagggatagcattaggagatatacctaatgtaaatgatgagttaatgggtgcagcacaccaacatggcacatgtatacatatgtaacaaacttgcacgttgtgcacatgtaccctagaacttaaagtataataaaaaaaatttattactagtatattgggaaacagttgattttttaatgtattttatgttcatctactttgctgaagttagtcatgattcatttaatttactcttgcacttgatatgcttatactttatttacaatttttgcatctttgctcataaatcagattcctttttaagtttctgttgaaggatgctgtcattattaagtgtggtaaagatttaataaaggtctttataaaggattactctagctttttaacataattagggaaattttctggcagtactaaatttaacacaggaattgtattttccttgaagaacttgtccatgaacccatcaatatatagtgccatttttgtgtgtgattctttgagaaatttttataataacaatggctattggcctagtaaggttttcttgcccttcttgagtcatttttgtagtttatattttacttttttgtgtttgtttgttttgttttgagacagggtctcactctgtcacccagactggagtgcagtggcgccaccttggctcaccgcaatctcggctcaccgcaatctctgcctcccaggctcaagctattctcctgcctcagcctccagagtagctgggattacaggcgtgcgccactactgcctggctaatttttgcacttttagtagaggcggggtttcaccatgttggccaggcttgtctcaaactcctgaacctcaaatgatccaccctcttcgacctcccaaagtgccaggattacaggtgtgagccactgtgcctggccttgtagtttatattttcctaaaaatgtatccatttcttggatatattgttattatcatagattgtacataatatcattttataaccctttataatgatttcttttctcactcattgcgtgatgtgttatcttcctcacatgtgcttgcattcatatctacatattcttttcttcaattttcctcacaagcagttttttaaaaatcctctttgtcttttcaaagaaccagctcatgggtaaatatataccttttctgttttaaaaattcatttaacatctgcttttatttttattttattcttgttttgctaaggtttattttgttgttttccctggctgcttgaattgaatgcttagtctgttttaattattcttgacttcataacaaaagattcaaagctatacattttcttctaagtatagttctgagtatatccaattaattttgaaaaatagtgttgtagctatcttgatttttctcaataatctgcagttgcaatttttatttcctcttcgaccctgttttttgttgtttttttagtgcttaacattttaaaaatatttccttttctttgatttatccttttattataaatttctagaggtatttcattgtgtattgaaaatgtgacctgaatgataatttctttcttaaagttaataaggttttcttcatggtttcaggtataataagtttgtataaatgattcactgaagaactgtattctctatagggtacaatgatcattatatcaattttggcttaataattatataatttatatgctaatttattttttctaatttatcaaagcctaagagcagtatggtaactacccacaaatattattgtttagttaatttctcctggcatttcttcacctctgccatcctaccttaacttccttgacttatacaatattttaactgaaaaattccaaaaaggaattttgaggaaagagactttattccagtgaacagtttgcaaactaggagataccagccttcagtgtaaaacaaaggtgtgctcctgagaaaaaaaattaagggtttaggttttccagcaaaggttcacaccaaggttgccaatctggtctatttatgcaaatgaaaaattcaaacttgcttagttctgattggtagatggtatacatagctgagttctgattggttgatacagtggaaccttcattggctggtacagctgaaccctgattggccaaggcaagtgaactccgaaaacctcaaaatttaaaaagtgtgggttttccacagacctctgagcacctatgtgacctctagtcagcaaatggtcacttgactgtattttaaatttaggcccaggtagctactgaggatccatcctgaaggattggctgtttctggtttacatttgttcactgtgtatatgtgcaaatgttcatatatatgtgtgtgtgtgtttgtgtgtgtgtacataataacccttttctcctaactctgtggggtaacaactataaattgtttagggtgtatccttacagatcctttattatatgtctcatcacttttttaaagttttttttttattatcctttcttttaaaatcctaagttatatgagcaatacatgaaatatagcttttaatgggtgtgggttatatgatatttttgttgtatgaataatatgaataggttatgctgtacacattgctttgcaccttgatttttaggaataagtcttagtcatctttccatataagtatagatctatgacattcttttaaactgcagcatgatatccttttatgtgaatatagtgtttattttgttaaccaactcttttgatagacctggtctgttaatttcccctcaagtaagctgagataatttgcatattttagttcattccttcttctgattttagttaaaatagtctagggttttagatccagattatatgtaatatattgtcttccctatggataattatttttgacatttctagatgtgagcctgttttccttaattttgtctggtatattgtgagtcctttcagtctaaaagttcattatttctttgactcagataaatttttatcttttattttttgacattattacccgtcttccttttctcttcgtgtgtgtatgtgtgtctccagaatttattccctcaagtttttattcattatcttcaactttcttttatctcttaattctgggagaatttcttaagatagcctttggaataattgatttggttttggcagtatctaatatgctgttcactgcctctgttacattgcttaaattagttctttttttcatcagaaatcagtctttctggattccagaatgtcgtcttttcatagattcagtgtcctctcagaccttgttgagggtgtactctttaaaagtatatttcagttctttggagcaaaaagattgcataaatagacacttactctgattcttcaggatttttctcctttaaaaattacttgttcttttttcatacatctggttgattttctctgtttgtatttgtagaaggtgatctttgagttttggaatttgaggcagattttatcagatttgtctcctagttcaagactacgagtactctttatatgttctatagttttgatttatttgttactttccttttgtttcttcttacccatctctagacagggaaagcagttgtttctgaagaattggaagagtgttctaaccagaagcacttgtgaggaaaggagagaatcttgctaatgtgctgagggacttcttgtccatatttgttgtagctgctttaaattacctggagcactgcccctattttctgaccagcacaaagacccttgtttggagcctgatgctgagagggctgaaaaccatatcatgtgaagaatagttagaggaagtcaagttatttgttctagaatgggaaagatttataggagacataataactatcttcagtagttaaagggctgtcacaagaaggattagacttgttctatgtgtttccaagtggtagaattatgttagaagggtatcatcttacattcaaggaaggagaattgctataactgacacagcttgtgttttaaatatttattgactctagatttcgaccattcattcagatataatccacacactttgatgttaccacttgataccaacacgcatgaatgcatgcataagtggccaagtgcctatgtgaggtactaggaggctatgcaagcactagctatggcatttgctcacagaggcattatccttagagaactgctgctttctattcctatcctctttttatttttcataatcaccttactgtaatttcttgatacttaacgtggtagtcattacttttcacatgcatgagctcgtcccatccctttctcttgacattcctttagacagtgtgataggcagaagaaaaagtccattttctaatccatagaacctgtacatatgttaccttatctagtaaaggggaattaaggtagcagatggaattaaggttgctatcagcttaatttaagatatgcaattatcctcgattacccaagtgggcccaatgtaatcacaaggatacttaaatatagaaaagggaggcagagagtgatacaatgtgagaacaacttggctggctattgctggctttgaaggtggaagggcccacaaaacaaggaatgcaggctgcctctagaagctagaaaaaaaagaaaattgattctttactagaacctccagaaagcaacacagccttgatgacaccttgatttttaacccagtgagactcattttggccttctggcctctagatctgtaatataaagaattggtgttgttgtaaggcattatgtttgtggtaatttattatagtactgtgttagatcattgtcacattgctataaagaaatacttgagaccgggtaatgtatttaaacaaaaaagaagtttaattggctcacagttctgcaggctgtgtaagcatgatgctggcatctgctcagcttctggggaggcctcatggagatttttactcattgcagaaggtgaagcaggaggaagcacatcacatggcgaaagcaggaacaagtgggggaagtgccatacacttttaaacaaccagattttgcaagaactcactatgatgaggacagcaccaagccatgagggatctgtcctcatgacccaaacacctcccaccaggccccacctccaacactggggattacaattcaccatgaaatttagaggggacaacatccaaactatatcatttcacccctggcccctcaaatttcacattcttctcacattgtaaattacaatcatcccctaccaatagtccccccaaatcttaactcattccagcatcaagtccaaagtcttatctgagacaaggcaagttccttttacctatgaacctataaaatcaaaacaagttatttacttccaagatacaatggaggtacaggtattgggtaaatactcccattccaaaagggagaatgaacgaaaggggctataggcccccacataagtctgaaacccagtagggtttaaatctcaagccgtgtcatttaatcttaaatgtattaaagtcattacatcttgaagctccaaaacaatctcctttgactccgtgttccacatgcagggcacactgctgcaaggggtgggctcctaaggctttgggcagctctgcccctgtgactttatggggttcagccccggtagcttctctcatgggctggagttgagttcctgtggcttttctaggctcaggatgcaagctgcccatggctctacaattctggggtctggaggatggtggcccccttcccatagctccactaggcagtatcccactgcctagtgggactccagagtggggactctagtgagggggttcaaccccatatttcccttccaaactgccctcataaaggttctctgtgggggttccacccctgcagcaggattcagcctggacatccaggtttttccatacatcctctgaaatctaggtggagggtgccaagcctccttcactcttgcactctgtgtgcctacagacttaacaccacatggaagctgccagggcttatggcttgcaccctctggagcagcaggcctaagtaactgggcccctttgggcccctttgaactgcagctggagcttcagggatgcggggagcagtgtcctgagtctgcacatggaagcagccccccactcaccctcctaggcctctgggtctgtgatggaaggggctgccttgaatatctctgaaatgctttaaatgcctttttcccattgtcctggctattagcacttggctcctttttagttatataaatctctctagccagtggttgttcctaagcctgcttggattctttccctgaaaacagtattttcttttctaccacatgaccaggctgcacattttccaaacttctgcactctgcttcctctttaaatataaactcccaactttaagtgatttatttgctcctgcatctgagtgtaggcttttagaagcaggcaggccccatcttgaacacttttctgcttagaaatttattctgccagatatcctaggttgttactttaggttcaaacttccacagatccctagagcatggacacaatgtagcaggacgagtcgcagacaagaacccctcggacaccgagttgtggaaggaaagggctttattcagctgggagcatcagtggactcaggtgtccaaaaaccgagctccctgagtgagcaattcctgtcccttttaaaggcttacaactctaagggggtctgcatgagagggtcgtgatcgattgagcaagcagtgggtacatgacttggggctgcatacaccagtaatcagaatggaacggaacaggacagggattttcacagtgcttttccatacaatgtctggtatctatagataatataaccgtttaggtcaggggtcaatttttaactaccaggcctggaatgcagcgccagactgtctgactactgatttcacttctgcctttaactcctacttttcctttgaggcagaaattggtcataagacaatatgaggggtagtctcctcccttactacccacccctttgagaacctcactcattagtgggagttctcactttcttcctcactacctacgtcttcttgcaagacagatcgatagtgattcatatagaacacttgtgctgaagcattttggtgaactaaggtagcgatgaagctttttatcacttgaagaagtacagggagtagtaagcaggttcctattactattataactcctattataagagttttaaatcctcctaggtctgggaaccattttccaaacatggccccaagatcaaatccatgccacacttgcatgggcatatgtgccagttttgtcatatctctatgtcttcaactacttgcccttgatcatctatgtgtagacagcaattagtaaggttaaatttcctatagacctctccttcagctgctagcaagtagttgagagccaatctcttttgatagatagcatttcttatctgagtttcttgccaggccagaatagtcaaggctctgttggttttattagtgattatttctaagacagcttgtaactatatgatttggttgaacatgtaaatgggggtccggtatccccacaagtcatcttgtgcccacgtagcaggcccataatattgtatgattctctcgggaccattcatcatctttctaatttcctatagctatgcttctctttttgcgggaagcatggacagagggcagcccgggagtttgcctgtttttatgggcagtaggaagaaagatggtttaataatgccaataacacaactacctgcccactggttgggtaatttggcataagctctatgcccacatatccagtaaaatccagtgggcgccgtccagtcccggtgggactccaggtggatccacacggtttgcaactttgggaatttactaaatgtattcctttctgtgtgatttgaactccaccaagtgactgtttttgtggtaccattatacagtttctgtcccagacaactaagtcatcctacggggtgagtgaattcttttccctctctagctatgcaatattgtccaataattgaggcttttaggatgcagaaattatcagggtgattcttctgagccgggaattaatcaggaactgggtctgtaggtactaattctcaggcttgccatggccattggtctcccattacaattcctccacatacataacatgaagtgacattgagagactgggctacatgctcggctaattgcaaaaacaaatttcttgtttttcctggaatttctggtactggcacatgtagttcatcatagaaagtttgaaacattggctcaggagagcgtttgtaaacttctcctcgaactaagatatttactcgaggattcagtctggccccactgattcctaaggccacacgctccccttttttccagcgagaatcaaggggattggttattaccagctctaaggggttacattgtcccttagtacaggaagagccactttttcctttctgaaggtggactggatccttttcatttttttatccaagtggcccaaatgacacaagaccagtatccacattcatttacacacagtcctaattcatgacaaatgtacttattttcagtcatatagcctttttcccaatcaaaagagccacatccccttcctaacttattgctattaatgacagcacaggcatcaaatttcaagattatgcatttgggcaccctttttcttctgttttggctaatactttacttatatcatttacgagtccccacctgtcttcagtccttaatcttatttcaaaaactgtggacatgggaggcttagaggggtcataacacacatctggctggttgtttcctgggctacataccttgtactgagtgtcattatataaacatgttccttttaaagttcctaggcattcatagtaactatagaacagaaagattgttttaacttgttgccctacctcggtaacctgatgtatacactgacagcagtcctcaatgtggggaaaatcagtggaggtttttactatacaagtccaaattataaggaaaatgagtcccacgatgatcctcctcatgcttcggctgtgcgtagaccagtcagcttccgggtgtgactggagcagggcttgtcgtcctcagagtcactttgcaggggttgtccaggcttggtttcgcctcccagatttcattggctgtggtggatccaggctgggattccttctacctttacagccttgggggtggtcaggatgacggtctgaggtcctttccactgtggccgcaaaggggctacattccaatccttcatccacacgtggtcacctggagagaaagggtgaactggggagaataagctgatgggacatttctcatttacccaagttgaaatagtttgtgtaatttttcctaaagcctgtagctgtcgctgtaattcaatttcacctaactctcagggagtgcctggaagcccccccgtagtataggaggaggcctatgatacagtatttcataaggggagtatcctgttttcttagaaggagtacatctaattttaaacaataccataggaagggcctgtatccactttaatcctgtttcctgacatactttccctaaactatttttgatagtccgattcattcgctccacctttccggaactctgaggtcggtaggcggcatgtagcttccaagtgatttctaatgcctttgctgtcttctgtaccaagtcagccacaaatgctggcccattatccgagccgattcataagggcagtccaaacctaggaataagatctcagagaagcacacgggttacctcgtaggccttttcagttcgtgttggataagcctccacccatccagagtaagtacacacacgaaccagcaagtacctattacctccacattttggcatttctgtgaaatccacctgaagatcctcaaaaggagccgctccataagcttgtatgctgggtggaacagtggggccttgcctcgcattgtgctgttggcaagtaacacactgttgttgtgttacggctttggcaagtgctggcaactgtgagatgtagaagtaccggcccaacaatttttcaagtgactcttgacctggatgagtggtttcgtgcatggccaatacaattgtggctcccagcaactgtggcacagctactctcccatctggcagtctgatccatcctccttttattacttaccccccttctgcatggaagaagtctttttcttccttagaataggtaggtaccaggtcagatgtttgagggagtaagggggctgctaccaatgcctggtaaggggtagatgctgcttttcaagcttctgaatcagctcgagagcttcctaaggccactgagatggaggctcgctggtgtcccctgcagtgcatgactgccaccttctgaggtttccacactgcctctagtaattgtagaatttcttgttgatattttatgtcctttcccccagagtttagcagacccttctccttatataatgttccatgcacttggagggttagaaaggcatatcgagagtcaatgtagatgtttacagtcttaccttcactgagttctagagcccgagttaaagcaatgagctcagccttctgggctgaagtgccctgtggcaatggtttggcttcaatgacagcatccaaagttaccatcacatatcctgcacatctttctccttgtgggttgatgaagctgctcccgtccatgtataactcccagtctactgatgcccatggctggtcccaaaggtcaggtctgctagaataaactgagtccaacacctctacacagttatgctctaccaggctctctgatactaggagcagggtggcgggatttagggtgttacagacttcagtggttatgtggggattttcacacagcaagctttggtactttgttaatctagcatttgttagccaatgatgtcctttggttttcatcaaagttaccacagcatggggggcctttatattcaggttttgcccaagggttagtttatctgcttcttgtgctaacagggctgttgctgccagggcccttagacatggtggccagactttggaaaccccatctagttgttttgagagatagaccactggccttggccagggccccacagtctgggttaaaactccaactgccattttttctctttctgacacatagagtgtaaagggctttgtcaaatctggtagtcctgggactgggggccgacataagtttttcctttaacttacaaaaggcttgctgttgtagaggcccccattcaaaaggctcccagtcgcctcctctgtaaccctgtacaaaggtttggctagcactgcaaagtttggaatccataatctgcagaaccccacagctcctaggaattcccttacttgccttctggttttaggttccggtaggctgcagatgacctgctttctttctgactccaggctgcgctcccctttctgaatagtgaatcccaggtagtgtacctgctgtctgcagatctgagctttcttcttggacaccttatacccacagtcctccaggtgccaaagcagggcatccgtcccttttgtgcacccgactgctgtggagtgtcccagcagaaggtcgtccgtgtactggagcaagcctaggtctttagcaggaaacttttgcaggtctcaagccagggcctccccgaagatagtaagggagttcttgaatccttggggaagctgggtccaagggtactgagtagtgacacctgactccggatcttcccactgaaaggcaaacagcttctggctttcaggagctagtctgatgctaaagaaggcatcttttaagtccagacaggtaaaccagctgtcctcagcctgcagcagccctaacaatgtgtaaaggttaggaactgttgggtgcagagtcactgtagcttggttgaccaagcacaagtcctgtactggctggtagtccttggtccctggcttagggacagggaggaaggggaggttccatggagactggcaaggaactataattccaaaggctttcaagtgcctgagatgaacctggattccttcgagagcttctctgggaaccggatactgcttttgtctaattggctgggccccaggcttaacttctatgagtacagggtcttggttgaccaccagtcccggaggattatcatccgcccatattcggggccatcgcttagctagagctggttttatctcttggcctggctcggtcagaaaaagtctccattctttttccctggtgaccataagagccatgataactcctgtttctggtaagtttagctgtaaagagccctgttttgtaaaggagatggtggctctcagcttgctaagcaagtctcttcccagcaaaggcaagggacagtcaggcatatacaagaactggtgaactatttcatgtccccccactgagaaggtccatggtagacagaaagcctgcttagtggaaactcctgttgctctgattatatcaatggtttccttggataagggggtgaccagggtggtcactactgaatgttcagtaccagtatcgaccacaaacttaatgtccttgcccccaattgtaatcctgaccgtgggctccttgggggcgcttgagccgggtccccttcagtctaattgcccttcagccagattgaacaaagctcccttgtctttttctgaggtcttttgctccgaatcaccttgcttttccttcagttggggacacttatctttccaatgtcctatttccttacaataggcgcattggttacattgcagcatgggcgattagattgggtattcttcctggaacccccctttccctgtccttttgggggaattcccctaatggccgcagccagtaagtcggtgtttcacctggcctggcgttcgccttccttacggctttctctggggcttgttgcatctctattcacaaacacttgattggttatttccagtaactgcgaggtattcatacctgcaaacccagcctgtttctgcaattttctcctgatatcttccacactttgactaaggccatattaatcattctctgattttcaggactatctggatcaaaaggagtgtacatacggtaagcctcacacagtcgttcatagaattgcgctggactctcctcttttccttggatgacctcagagaccttatttacatttgtatccttttgagcctctttctttagaccttctatccatgccgcatggtactgtcttagcctctccatgtctggccccttgttcaggtcccactggtggcctgttcctggcagctgaattcttctatattcttgagggttttggtaattggctaggacgtgctcctctagccacttagttgccgcctggagcacccttcacctttcatctgtattaaagaggtacatgagcagctggtggcaatcagcccaagtaggattatgagtctgtataatagtttggagcaagtcaattaaagcttgaggcttttcggtgtaagttggagtattatttttccaattgaggtcagcagaggtgaaaggttgatacacaaaggctgccttttcaccatgtgtctgtcctcatctaccccagtatattgctgttctctcacgggcatttggatttcagtcttgggccgtaagtgagctgccaagggaggagtttctcccatggcttcacttcttcttttgtctactctgggtggtctaggagtatggatatctggtggaagtggaggtgctgtgggctcaggaatggggagcccttcctctcgataaggaggaggcactgctggtaccaattcctgccatgattcttccggtgttggctcggacaggacttttggtgccgacttccctcggtgggtggagtgacagccttccttaactaactgtccctttgctactagtactgctgctgcctgtcctcttaaccactgtgggggatccaaaactagctgtaaccaagaatctatatacgggaactgatctgggtgccctggcttacaggttcccctgtgccataccttcgagacaagggacctgtccaggcttccttctgatggccaacccacctctaatgctggccagtctatctcacacaaagttctaagttttcctggtgtcatagtaactccatagtctcccttaaatccctttttgaaatttttcaacatagttcctagtgaggtgggcttactttgtgcctgacctatgtttccttgagacaaaacaccatgctcacaccacacgcacaccacaaaacagaatgggtaaagagggcacacacacacttttacagtttataccaaaccagaatcaaaaccaaaatcagagtatcaagaaatcccagccaggtcagaaacaaaaccaaagtatcaagtaatccaagtcaagtcaaaaacaaaaaccaaagtgccagtgcaggcacgtcatgggtgattaggccacgcttccactcaaatggaggggtaagttccaaagaccagtcttaacaagttccagatgtccagactccaagtaccagttccttcctggtgttcagccactgcattgatcctccacaggcacctgccatgcactgctctggtgaggcgttccactggggcaattgcctacccgggagcgctctcaggatccacgttgctcaagctggctggagtcccccacagggatgctccacagggcaggcctaagccgcctaaggggctgccttgaccgtccattaatcacctcacttcccagtcagggaaccaagaaatgtagcaggatgagctgcagacaagaacctctcagacaccgagttgtggaaggaaacagctttattcagctgggagcattggtggactcatgtctccaaaaaccgagctccctgagtgagcaattcctatcccttttaagggcttacaattctaagggggtccatgtgagagggacatgatcgattgagcaagcagtgggtatgtgactgggggctgcatgcactggtaatcagaatggaacagaacaggacagggattttcacagtgcttttccatacaatgtctggtatctatagataacataaccagttaggtcaggggtcaatttttaactaccaggcctggaatgcagcgccaggctgtctgactactgatttcacttctgtcttttctttaactcctactttttctttgaggcagaaattggtcacaagacaatatgaggggtggtctcctcccttaacaatatagccaagttctttgctaaggcatataacaagggtgacttttgctgtagtttctaataaatttttcatttccatctgaggcctctttagcctggacttcactgtccatgtcagtatcagcattttggttacagccatttgacctgtctctaagaagtttcaaactttccctcatcttcctctcttcttctgagccctccaaatgtttctatcctctgcccatttcccagttccaaagttgcttccatattttcaggtatctttatagcaatgccccactctttgataccaattttctgtgttaggcaatttttgcactgctgcaaagaaatacctgagactgggtaatttattctaaaaagaggtgttaatccaaaatatctgagacaggtctcagtcaatttagaaagtttattttgcttccatgacacagcctcaggaagtcctgatgacatgtgcccaaggtagtcagggcatagcttggttttatgcattttggggagaaatgagacattagtcaatatatgtaagatgtacactggttcactctggaaagatgggacaactcgaagtggggagggggcttccaggtcataggtagataagagacaaatcgttgcattctttcgagtttctgattagccttaccaaaggaaccgatcagatatgcatttatctcattgagcagagggatgactgaatagaatgaaaggcagacttgccttaagcagttctcaccttgacttttctctttagcttagtgattttggggtcccaagatttatttttcttttgcagaggcttggctaggtatgatggctcatgcctgtaatcccagcactttgggaggattgcttggggccaggagtttgagatcaacctggtaaacatagcgagatcctgtctctcaaaaaagaaaaaatagaggtttgattcacagatctgtaggatatataagcatggcactgctatctgcttggcttctgaggaggccccttcagggagcttgtacttttggcagaaagcaaagcaagagcaggatgtcacatggcaaaagcaggggcaagggggtggggtaaggtgccacacacttttagacaaccagatctcacaagaactcactattgccagaacagcaccaagccatgcaggctccatccccatgacccaaacacacctcaccaggccccacatcccacattggggattacaattcaacatgagatatagaggggacaacatccaaactatatcaggcaccaataggaaactaacacagaacaggtttctgagtagatccaaggccatattccagaaacagtaagaactgtttcttggtatttctgttattcagaaatttaatatgtgtattgctgaaccattatatttgaccatcttcggataatcattcatccatgaaaatacacatcaatttctccagtgcttctcattgacatactttttggatcatctaggtaccagtcattaagagtaacctatacaaggggaggtccacttaagtgaaacttacagggagggtaatgtcactcaatataagggagaattttctgttaaagccattcaaaaagagattgggctgtatttagaggtttgtatggcaggatctaaacaactacttggtggagatgttaaagagaacattcatgcattggttgagttgttggataaggacagattttattctcgaatcctaagaacccaagaggttgtgaggaagaagcatcactgaagattggatgggactcttgtgtatagatgtgcaaattatgcctacacaaggtctctagccaaggctgaaaccaccaatagaatctagctcacactttgtttgccaagctgtgcattctggctgtggggctgctgtgccctgaggcaggagtaacctttggctaattcatataaaggtattatctacttgataagatgtaggcttgaagggctgcattcacccaaagaagacactttttttctaatttgcagaaaggtactgcaggggccagcacaaaccatgggactagggctataggagatggtttcttggagttggtgaaggcaagacaaggatacataagaaaaagaaactagaaatcaatagcaggaggaagttggaaaactgtacaaatacatggacattaaacaacgtgcccctgaatgacaaatgggtcaatgaaattaaggaaatcaaattcttgaaacaaatgaaaatagaaatacaacatacgaaaacctatgggataaaacaaaagtggtactaagaggaaaatttatagcaaaattttatttaaaaagtagacaaagatcagccaggcgtggtggctcacacctataatcccagcactttgggaggccaaggcaggtggatcatgaggtcaggagatcgagaccatcctggttaacacgatgaaacccccgtctctactaaaaatacaaaaaattagccgggcgtggtggcggatgcctgtagtcccggctacccgggaggctgaggcaggagaatggcgtgaacccgggaggcggagcttgcagtgagccgagatcgcaccactgcactccagcctgggagacagagcgaaactccgtctcaataaataaataaataaataaataaataaataaataaataaataagtaaaaatttaaaaataaataactttacaaaggtagacaaatatcaaacaatctaacaaagcaccttaaggaactggaaaagcaagaactgctttaacccaaaattagtagaaggaaagaaataataaagacgatggcaagaataaatgaaatagagactaaaaaaaaaaaatacaaaagataaacaaaacgttgatttttttgaaaagataaataaaattgacaagccataagctagactaagaaaaaaatgagagagaacccaaatgaaatcagaaaagaaaaagaagggaaggaggttatattattaatactttaatcccagtctggcttctccagtcccttagctcacttccaaattgtgctattggtgtctgctcccaattgatatattctgatagcatatctagttgggaagagaaagtagtacatgaataaactccatatttcagagctaaataaacatctcctttgggaggtcactgtacaagttggcagcaaatggagaaagcaagaacctaagtattagagatcaaagggagaggatgtgtccactcaaggctctcatagagaaggcagagcatttctctctgatttgtaaggctggtcaactacccaaatgtgtaaggatagataatgccagtgtcctcaaaggcacaggagatatacacaggaacctagctgaagcagtttctgtattcgtagcagagtcccagctagtcaggactgttcttgatgttgcagatactccaggtagctagatctgtctggaggcgactttggagctggacaatatgcagatctgtgtcgtgtgtgtgttcctccaggtgtcctttgagatgacccatgagaccctgtacttggcagtgaagctggtggatctctacctaatgaaggcagtatgcaagaaggataagttacaactccttggtgccactgcctttatgattgcagcaaaatttgaggtgagtctgagtccctatggcctggagaactaatcaagtttctgtccaacccagtgaatgaatatatattcatatatattcattgttatgtgctgcataacaatgttttggtcaatgatggactgcttatactatggtggtcccataagagtataatggagctggaaaagtcctatcacctagtgacatcttatcttttgtaacattgtaatgttacaaaagataactcatatggtgatgctggtgtaaacaaacctattgcactgcaagtcataaaagtatagcacatacaattacgtacagtacataatgcttgataatgatataaactgttactagtttatgtgttcactgtacttttaattgttttattattattttattagagacaaggtctcgctctgttgcccaggccggagtgcaatgatgtgatcatagctcaccataacctcaaactcctgggctcaagcaatcttcccactacagcctctcaagtagctaggactataggcatgcaccacagtgcctggctaatttccagaaatttttttgtaggggtggggtctcatgttgcccaggctggtcttgaactcccgacctcaagcaatcctcctgccttggcctcccaaagcactgggattacaagtgtgagccactgtgcctgacctggtttagagtatactattacttatttaaaaaaaataaagttaactgtaaaatagcctcaggatgtccttcgggaggttttccagaagaaggcattgttgtaggagatgacagctccatgcatattatgacccctgaagaacttccaatgggacaagatgtggaggtggaagacagtgatattaatgatcttgaccctttctaggcctaggctaatgtgtgtgtttgtgtcttcatttttttttattttattattattattatactttaagttttagggtacatgtgcacaatgtgcaggtttgttacatatgtatacatgtgccatgttggtgtactgcacccattaactcgtcatttagcattaggtatgtgtcttcatttttaataaaaaagtttaaaaagtaaaaagtaaagccgggcatggtatttcaatgcctgtaatcccagcacttggggaggctaaggcaagaggattgcttgagcccaagaatttaagaccagcttggggaacaaagtgagaccccatctctacaaaaaaataaagcagattagctgggtattgtggcacatacctgtggtcccagctacataggatgctgaggcaggaggatcccttgagcccaggaggttgaggctgtagtgagctttgttcaagccactgtattccagtctgggtgagagaacaagaccctgtctcaaaagaaattttttttaaagaagaaagcttatttaataaggatataaagaaagcaaatatttttatacagctttatactgtgtttgtgttttaagctgttattacaaaagagtcaaagttttacaaaataaagttacagtaagctaaggttaatttattatcgaagaaaaaatattttttatgaatttagtgtcgcctaattgtacaggtacagtgtttataaagtctatggtagtgtacaggaatgtcccaggccttccattcactcacacactgactcacccagagcaacttctactcccacaagctccattcatgttaagtgcccaatacaagtgtactggttttaaatcttttatgctgtattgttactgtactttttctgtttagatagcctaaacaaataccattgttttacaattgcctacagaattcagtagagtcacatgtgcataggtgtgtagcctaggagcaataggctatataccatataacctgggtgtgtaggctgtaccatctaggtttttggaggtacactcttatctgtgatcttctcacaatgatgaaaatgatgcatttctcttaacatatccctcttgttaagtgacacataactgtgtatacatacatttatttgtacatatatacacatgtgcatacacatcagtgtgtatatgtgtgtgcatacagttacatacatacaaataatttttttctgccgcattttttgtccctcttcccaaagcagagaagctggtgttggttggcaatggtggtgtatttgtttcctggcatcaacaaggttcttccattttctgtctgaagatgtattatgtgggcatccaactaattaaatgggcagttctttttacagcttccttctgctccatgattctctgcctccaccattttcttgttccaccaactccatccccatctagtggagtctcaatctgcttatataacaaagcattgcctaaccagggtgctggagacatttaagagaaaatggcgtgatgttgatggcagtgagtctaaatggtccaggtgaaatagtaatttgggaagtagcagtataaaagtgagtagctgaccttttcttcatgaccataatccatctaactaacctctctgattccccttccttaggtgctaactgatcttgttcaactttcatttttccttcagctaggctagttgtaggaagccttagggtttgggagcagagagttggcaacttttaccaaggatttcaaagaactttagaactgtgggtttgtttctgtgttggctccctccccagctcctgccttcctctcctccccaaacacatactggctcttaccccctccctccctccctgcctcactctctccctccttaacttgctcccttcctcccctccttctttccctgtcacctgcccttcagtgattgttttccctcactcaccaccccactctcctttgttgcccctcactcacctgctcacttgagccctccctcactctgtcccttcgtcctgtgccagcttgcttgctccctcctcccttcctcctgcttttcctcccttgctcactccttcccttgtttcctctctccctccctcacctgctggctccctctttccttccctccttgcttccttcccaggctccctctctcacttggtggatagattcctctctccctggctagtctacaccctccctccctcggtggcttgctctctcctttcctctctttcccttgctccctcacctgctctctccctccctcacctgctttcttccctcccaggctctgtccttccctcccaggctccctctttttcttccttgcccactctctcccttccttttttactctgggtacttcttagcaaatcctgggagttggagcacccttcctctgttggccaggacagagggcccctaccaagtccatggaggaggggtgtcttcctctcacaggattaagaagtacagaaagccttttgtttaggggaggtgtggagatggcatgaggagagaaaggagacagtagccattgcacagagcagcggaagagagaggttcctgccctggtgttgccactagcttgccgtgtgaacctgagcacatcacttttctctgagcctaggtttccttgtctgccaaaccaaagggttggtcctgtctgtcatccaaaaataggggaaaggtgggggaagaaagctgttgcgggcagtaagctgcaggtagggagaagaattaggggccttcctgtgtcctcattgtttctccaaaccaatgtttgacctccagagggcagagccctggaaggtgctccctggacagaggttcttctcaccctcagcctggcctggcccttccttgtctgacctctgggtgcctccgcacactctgcccaccacagacttttgtctctgcttaggttccctctatgcctgtctgcctctccacttctctcactgccaggtaccctgtattgccctcctcaaacatccttactcattccctacactaggacacaaaatacaggcttattttctatctctagctcccatttctgtggcttccttctgtccctccctccagagaaggccttagatttcaacattcgtggttctcagagggcagatggctgctcctaggccctgtgcccccattatgttgcttctggcactgtaagaatccacccccaggaggtcctatcctctatctggtggtggtggtggtacagttttggggcaggcctctcctgtcctttctttggtttactttttctgatgagccactcacatcaaccagaagctgagtctcagagataccctgaagatttatgccaggaaatccttcacccttctccctgctgacttttacctctaagcagaaaggttgggttgtctgtctggttgtcacctcctctcctctccacccataggagcacaactcacctcgtgtggatgactttgtgtacatctgtgatgataattatcagcgatctgaggtactcagcatggaaatcaacatcctgaacgtcctcaaatgtgacattaacattcccatcgcctaccattttctgcgcagatatgctagggtaagagagaagagacacatcttcattctcccactgctgagttagtctcctttatacccagagtagctgccttgagtggtaggaaaggggaaagggacaacaggcagcagggagctttctccttccatccaatctcctaggttaaagcttggcaatctttatgaaatagtgggaggtgggtgggggtgagttgcagatttccacagtgtgcctataaggttttgaagtgaggccagagttggggaggagaaacgtttcttttatcagggagagacacatggaaaactttgtggggggatgctggcaatattctcattctttgcctgagtattggttacaagggaggtcactttataattcattgtattgtgcaaatgagtgcgatgtacttttctctttgtgtgtgtgataggttgtaatttttaaaaaataagtttaaataagaaaagggaaaaggttgttttgaggtatggaacaccttctagggaggaccaggaacagagtcacggtgggaggactttggctctttaaagaatgacccatatagcaaggggggatgtgggccagtaccatacacacagttggtaatttgattaaaatcctaaaggtggcaaatcccactgactgtttcagaatcccccctaaagagtctgtttttgtgggtagggaagatgaagtgagttacggttgcaggagaaaggcacattactcaaacagagggccactgaggctcgggatgatgtaactggagagggagtcctctgcttggtgccagttttctaaattgatttctgagccagtcttctcattgcctttagtgtatccacaccaacatgaagacactgaccttgtcccgctacatctgcgagatgaccctgcaggaataccactatgtccaggagaaggcttccaagctagctgctgcctccttactcctggccctctacatgaagaagctcggatactgggtaaacacttgcgagataggggtataggggtagagatttaaaaagcagaaggtcagctcatggggaaggtgtaaattaaggccacgggaaactcttggggacaaaactgacacatattcaccactgtgaactctaacacctggacaacttggggcaagggcttctacagcaatggttttgaattatgccatttttcataatcaaagtaccctttgttccaaagaaagctcacctgaaagcccaatattacataccagactactgtgaaggtattctggttgtcatatggggtagtgtgaccctacttcttatccccagccctgttcccctcttgcctcttgcaatcccctcagcaagactggcccctgaggcagcttgttggaacagggtttgaaaagcactgagccagagaagagtagtgaaagcaactgtctgtgtctacaaaagtggcactcaggggcatgactatagtgttcttctctgaagaaggctctcaaagcctcctgctccaatacaaataaaactcatatttgatgctttctcaattttatgaaaagttgggggtaaaatcaactttagataatttcgcattcttactaatgatatgtataatatataatccaagtagcaggagtatgcttgcaaatgcagcccctctgctcaaccacttctgagctcctcctacctaaaaatcctggagccactgagggaagaacctctgtgggctgagaaagaaccacataaagtagttatgtgaacttggagaagccatactgaaatttcttgaaacagagaaagcattcaataaatgatagtgatgatgaaaaagaataaataataatcatgactggcatttattgagtgtttagacagtgatctaagcactttgtgtattaactcatttaatctccacaacaaccccacatgatagtaccgttatccctgttttgcagataagaaataactcccatgtttacacagctgatgagaggtggagctaggctttggaaactaggagtggtgttcacaatccaaaccaactgtgtaatcagaatgggcgtggccacagctctggagctgagggtctggaggccccatgctgaaccaggctttgacccttggatcccatggaaatccagtgggccgtgagggggacagctgatgggttcaggcaagcaaactgtgtgccaactaagatagaaatatttcagtgttttcacacttggtgactaaaccagggcatatcagctaaatgtcagcccgaatctgaactcaggtagtctgactccacaatcctctatgttagtatactgcctctcctatagataaggaaggcttcacagaagaggtgacttttgagctgggtcttgaaacgtatgcaggaacttgtgagaggagacattctaggtagagggagcagtaattaaaaagacgtgaaggcattaaggagggagtgtgttgtgtttagggcagaataagacatcccctatggatagaacagagaatatggtaaaaggagaggtgctaatgatgttaatagtgacagatgagaccagaatggtagatcatggtcagattgtgaaagaaaggctttgtataccacgctgagagacccactttacactaaggcattgaagggtttttaggcagggaggtgacatgctcctgtttgtgtattttagaaacagtactggtatagcaaaagagaaggtagagtaaatgagagagaatataaaggtgggaacaccagtgagcaggctattgtaacatagtcaaggtgaagcatttgagggtctgaactgacacagtggcactggggccttttagtcttatttaacacatccagtctactccattacccccttgtgttactcccctactcagcacgccaatgacggccctttgccggtggtggtggtggtttccaaacagtatttgggggagccctgggtttcctgcagaattctctcagggaccatgtaaaagataaagggatccaaatttgtgggcttcttagctcacacccccacttccaggtaagctatttgggcttccaggtaagacacttgaaaaagaggagttcaaggaaaataagacattttgaggaaaccactgacttataaatcctcttcctttctctgtctgttgagctccccacttaaccaaccattgtggacatgctgtcctctgtgaagctttctgtgactctcctgacagagttcgtgggtcctgctgctgtgttcctccagtgtcctatgctcacttccattatagcacttatcacacattttttaactcgctgtttgcacatctgtctcctctactagactacagactcctcaagggcaggtccctcattcatttttgtgttcccaggatcctacatatagggcttggtaatcctagttagcattgtttggatacttactatgttccagactctgttctatgtatgatacacacatacacaaatacacacacacacacacacacacacacacacacacatttaaccctatgatggaattaccgtaataatccccatttggcagattgggaaactgaggtcccaagaggttaattaactggctcaaggccaagctgttaggggaactgaaatttgacctgaagcattttgcctccaggacctctgctcttaaacactgctataccgcttctgccacataataggcattcttagctgagtgagaaaatgaacctgtggaatgatagctgttagagccagagaggaggatcagccttaagttcatgttggctgtggagttggcacctaaactttgttctggggtttacctggccattagctctggacctgagagtgagcaaattacaaaatcagtcccgttccttaggactggtgaatttctgcttacatgaacatctgtgaccagggctaatatcttttttttttttttaagagatagggtcttgctctgttacccaggctggagtgcagtggtgcgatcatagttcactgcagcctcgaactcctgggctcaagcaatcctcctgcctcagcctcccgagtagctgggactacaggtctacaccaccatgcccagataatttaaaatttttttaaaagagatagggtcttgctgtgttgcccagactggtcttgaattcctgggctcaagcagtcctcctgcctcgggctcctaatatgctgagattacaggcatgatccctaccacgcctggccaagagctaatatctaactggtacgtatggatatagccatcccagtagtttgtggctggaatctattcttctatatagcatagtataattattgatcagcgtccagatggtgtgagtctttgaaatgttttgaatgtcatctctgtttaaaccatgtgtgggaagcttagacttgggatagcagagatggaggaacggtgtgcttcctatagtagaaatcactattcatgctgcttcttccaggttcccttcctggagcattacagtggctacagtatctctgagcttcaccccttggtcagacagctgaacaaactgctgactttcagttcttacgatagtctcaaggctgtgtattacaagtattctcacccgtaagtactaagccccggatgaggttgggtttgtgttcatttattgggaggctttaaaatactagaccgagactagcctcacttaagagaaaaagattcaggcacttttcaccttcctttctactctagggttaaagcaagataggaaactaagggctgtatgtcccacttgttccatagagcatgattgtatttgccctattctatgctgaggagacccctcttccttttgcagggtcttctttgaagtcgccaaaatccctgccttggatatgttgaagctggaggagattttgaactgtgattgtgaggctcagggcctggtactctagcagcagccacagggctaagcatgcatgttaacagggtatatttattctatgttcgaatttgtcttttgatcgcttttattcatttttcctttctttgtcttttcccaaactgataatgttataaatatttatgttgcttgtttttatgaaagaaaaaatattgtcatatttgactacaaatttaataaaaaattaatggttattgttaaaatggctcatttcccctcttattgttcaggagccccatgcacagctcaataattttttttttcttcctagtcaaggctgggccccagagcctagattacccaattccctcctctgtttagaagtcttctcctcatgggaagaggaattgagctaaccatgaactgatagatgggtctacagaaggaggattatggtgcccagtccaaggagaaagctccttacctgacaggtagacctcacttttcagagctgggcagctggcagtgtaggctaataccttttggtctcaatctcaggtattatgctttctttgcttcttcctagatggtgaaaagttggggatcaggattttaatccaaatgtagccttgctttcagttaggcagctttttagagtacaaatttgaaaatactcttggagtggtatgtgctgaaatcatttttggcccttgtcttctgccaggagaagaaattcctacctttgaaattggcaaggtgtcccatgaatgcaagcatcaaccacttgcccagtctttaattcatatagcattaagagattctcctttctttttcactctgccctacctttggggtgatgtgtactgggacagttacttaagttgttaatggaggagtggaacatccagtatgccagttgttcaagagctactgcctcagtctcaccccaggacctccccacaatccagcaagtaatgtctaccacagcaggagacctctaggactctattctagtattgtagctggcaattatcctgattggtctgtgaccatttgttaccacttgtcaaatattttgaatatcagtcctggagggtggacatttggtggagaggacaatcaaggaagcagttatggggaaaatgcctcttcaattctgtcccaagactctccatgctattgtaattacatcaccttttctgatgggttagagacagatggatgagcatgccaagcccttaggtgtctcagtgctttccttcccttccaatcagtttcccattcttcctcctgacttgctttgccttggagaccagacatcactaggtttcctcctgccccattccactgtattgcaagatgactaaggggtacagccagagaggtccaagctactcagcagtggttctgctggcacagccaactttgcatgaacatgctaaaagcattaggctggaagccatcttgcaaatctccagccttactaaaaggatgtgtcttgtacctgcttttgaattctggagctttacatcaaggggaaaaaattaaccaattgaattgtttccccctttttaccaaccctgttctttaaaggtgctaatgaaaccatcagtcatttttgttgttgattttgcaatgcctcaacatttattttgcacacactcatcactacttcaaaattaagatagctgttagaactggagcttgttagaagtgggtgcaaaagttatcgtggtttttgcctttccttttaatggcaaaaaccacgataacttttgcaccaacctaatatttagtgccttattaaagaagcacatctattctttatcaggaatttgctggcccagtgaggtggctcacgcctgttgtcccaaaacttagggaggccaaggcaggaagatcacttcagcccaggaatttgagacccacctgggcaatacagtgagaccctgtgtctacaaaaagttaaaaagttagccaggcatagtggcttatgcctgtggtcccagctactcaggaggctgaggcaggaggatcacttgagcccagaaggcagatgttgcagtaagccatgatcgtgccactgtactccagcctgggcaatagagcaagaccctgcttaaaaaaaaaaagaatttgcttttatattttgatgactgtctctctatatatgaataaaactagctttctttgtaaccttatgtatttttaacagttttattttcttaactgaatgcaaattactttatatatgtatatataactttatgtctccctatatctttaagatcataacagtttaaaaaacaaaactaaaaaattctaaaagtttaaactacaaaatcatctatataggtcataaaaacactctggtagagaaatgtgcctggtaattcataagtaaaacaaacatagcctgtgaaataatgtgacatgcttagaaaaatgcctgacacatagcatgaatatctaataaatggtggtggtactctctggtagaggaaggggcacagagtggctacagaggtaagtaggggtgagactgtttgtttgtttgtttgttttaaagaaaaaggcctggctgggcaccgtggctcactcctgtaatcccagcactttgggaggctgagacgggcagatcacaaggtcaggagtttaagaccagcctggccaatatggtgaaaccccatctctactaaaaatacaaaaagttagctgggtgtggtggcaggcacctgtagtcccagcaacttgggaggctgaggcaggagaatcacttgaacccgggaggcagaggttgcagtgagctgagatcatgccactcactccagcctgggtgacagcgcgaaactccgtctcaaaaataataataataataataaggcttatatggtatgttgaaggtttttatactaagagttttgattttggagatgtatccatcaaggttcagtcagaaaacagaaaccactctagttatttcgaacagaggaaatttaatgctgggaattggttacttaaggacagaagagctaagaagtcacacacacagtgtgaagcttctgttatacttagggctggaggaacagtagccaagaggtggtgtcaccagacccccagatgccagggatatcaagctggatttggaaccagtgatcagttgggaccaatgagggtagggctgatgaaaggaggctggagctgggaaggagacaaagttactgccagacctattgctggaggcagagtgagaaaggaaatagcctggcttcttcatattttaatagtttttggggaacaggtggttttttgttacatggacaagttatttagtggtgatttctgagattttggtgcacctattacctaagcagtatacactgtaccctatatgggtagtcttttatccctcacccagtcccatccttccccccaagtccccaaagtccattatataattcttatgcctttgcattctaatagtttagctcccacttataagtgagaacatatgatatttggttttccattcctgagttacttcacttagaaaaatggtctccatttttctccagctccatccaagttgctgtaaatgccattatttttttcccttttatggctgagtagtagtccatggtgtatatataccacattttccttgtctactcattggttgatgggcatttaggttggttccatatttttgcaattgtgaattatgctgctataaacatgcgtgtgcaagtgtgtttttcatataatgacttcttttcctttgcgtgcatacccagtagtgggatcactgaattaaatgttagttctacttttagttctttaaggaatctccacgctgttttccataatggttgtactagtttacattcccaccagcagtgtaaaggtgttcctttttcaccacatccacacccgcatctattattttttgacttttttggattaaggtggtatctcattgtgattttatgtgtatttccctgataattagcaatgttgaacatttttccatatgtttgttagccatttgtatatcttcttttgagaattgtctattcatgtcctttgcctactttttgatgggattgtttttttcttgctgatttgagttccttgtagattctggatattagtccttttgtcagatgtgtagtttgtgaatattttttcccactctatgggttgtctgtttactctgctgattatttcttttgctgtgcagtagctttttagtttaattaggtcccatttatttatttttgtttttgttgcatttgctttttggttcttggtcatgaattatttgcctaagcaatgtctagaagagtttttctgatgttaacttctagaatttttatggtttcaggtcttagatgtaagtctctgatccatcgtgagttgatttttgtttaaggtgagatatgttttattcttctacatgtggcttgccaattatcccaacaccatttgttgaatagggttttctttttccactttgtttttgtttgctttgttgaagatcagttggctgtacatatttggctttatttctgggttctctattctgttccattggtctatgtgcctatttttataccagtaccatcctgttttggtaactatacccttatagtatggtttgaagtcaagtaatgtgatgcctccagatttgttctttttgcttagtcttgctttggctatgcgggctcttttttggttccatatgaattttaggattgtgttttctagtcctgtgaagaatgatggtggtattttgatgggaattgcattgaatctgtaggttgcttttggcagtatggttatttttacagtattgattttacccatctgtgagcatgggatgtgtttccatttgtttgagtcatctatgatttctttcagcagtgttttgtagttttccttgtagaggtctttcacctccctggttaagtgtattcctaagtgttttatttttattttttacagctgttgtataagggattgagttcttgatttgattctcagcatggtcgttgttggtgtatagcagtgctgttgatttgtgtacactgattttgtatcctgaaactttactgaattcatttatcagatctaggagttttttggacgagtcttcagggtttacacataccatacaattcacccacttaaagtgtataattcaggccgggcatggtggctcatgcctgtaatcccaacactttgggagactgaggtaggaggattgcttggacccaggagttcaagatcagcctgggcagcatagtaagaccctgtttctacaaaaaatttaaaaatattaaaaaaattaaaaagtgtgtaattcaagttttcagtatattcagttttgtggttgggcatggtggctgatgcctgtaatcccagcacgttgggaggccgaggcgggcagatcacttgaggtcacaagtttgagaccagcctggccaacatggtgaaacctcatctttactaaaaatacaaaacttagccgggcatggtggtgcatgcctgtaatcccagctactcaggaggctgaggcaggagaatcgcttgaacccaggaggtggaggctgcttgaacccaggaggcagaggctgcagtgagccgagattgtgccactgtactccagcctgggtgacagagccagattctgtctctaagaaaaaaaaaaaagttttgtaatcatcaccacaatctaattttggaacattttcatcacccctcaaattaaacttccagcctgttagcaatcaatctcctttccccacaccccatgagccctaggtaaccaccaatttactttctctctctatcagtttgcctattctggacatttcatataaattgtaccatacaataggtggcctttgtgtctggcttctttcacatagcataatgttttcaaggttcatccatgttgtagcatgtatcagtacttccttttattgctgagtaatataccattgtatggacatatatacattgtgtttatccagtcattggttggtagaaatttgggtttttccactttttggctgttgggaataattctgctatgaacattcatgtataagtgtgtgggcctcagttttcatttctttcaggtatatacttgggagtagaattgctggatcatgcaataactctagtttaacttgagaaacctctatactcttccaaagtggctgtaccattttacattcccataagcagtatgtgaggattccagtttctccacaccctctccaacacttgttattatatttctactatagccctcctagtgggtgtaaagtgatatcttgtgattttgatttacatttccctgatggctaattatgttgagcatattctcatgtgcatattggccatttgtgtatcctttttagagaaatatctattcaaatcctttgcccatatttttttttttgaaacagagtcttgctctgttgcccaggctggagtgcagtggcacaaacatgactcactgcaggctcaatctccttggcttaagggattttcttacctcattctcctgagtagctgggactacagtcacttgcgaccacacccaactaatttttttaattgttatttttagtagagatgaggtcttgctatgttgcccagactggtctcaagctcctgtttgcacatttttaattgggttatttgtctattattgagtggtaagagttttttaaaaatatattctgggtcatatatatgatttggcaatatttgattataccaattgtcttgaaagttttactttcttcatagtgttatttaaagcatattaagtttcaaattttgatgaagttcaatttatccatttttaaatgtttttacttttggtgtcatagctaagaaaccatcacctgatccaaggtcttgaagatttatccctgttttcttctaagaattgtgtaggtttagctcttatgtttaggttttaaattcattttaagttaatttttatatatggtatgtagggttgcaacttcattcttttgcatatggatatttggttgtttcagcactatttgttgaaaaaaactatgtttcccccacataattattttgatacccttgttgaaaattaaattaaatatgagagcttatttctggattctcagttttattccatttacctatgtgatatctagccttatgccagtactgtaattctttaaatattaaaaacaatgacaaacaaaaattatattgctgtagctttgtagtaagttttaaaattaaaaaaaaaaaaagatatgagtcctccaattttttgatcctttccttttcaagtttattttggcaattctgggtcccttgcatttccatatgaattttagcatcaacatgtcagttgctgaaaagaagttcactgggatttttgatagggcttacatttaactcataggtcaatttggggagtattttcatcttaaccatcttaaatcttgctctctatgaacatggatatctttccttttatttgggtcgtgtttagttcgtttcaacagtttttttgtagttttcagtatataagttttgtacttcttttcctaagtatattctaagtattttttgattgagccatcagtcttggatcactttcaattacctacttcattccccacaaacatatttacctcttcacctatctcaagtatctttattttctgttttaaaggttggacagacccacctactgttcaaggcaactcaactaccttgggacttttctccctcaatttttctctgtcgtcttagcccttcccttgtttttccctgccaccatttcctgtactttcatcttcttcctcttttgtaatcttcatttctagcttaaaaacatgctcaagacactcttgctacatgcatacaaaatgaaaagcaaaacaaaacaaaaccccccatttttttttttcgagatggagtcccgctctgtcgcccaggctggagtgcagtggcacaatctcagctcactgcaacctccacctcccaggttcaagcgattctcttgcctcaacctcccaggtagctgggattacaggtgcatgccaccacacccagctaattttttgtttttatttttagtagagatggggtttcaccatgttggccaggctggtctcgaactcctgacctcaggtgatccacccacctcaggctcccaaagtgctgggattataggcgtgagccactgtgcttggccaaaataaaactctttatctgcatccacctcccacctgctgtccagttcatctcttctttgtactaaacttctttttaaagtacactgactcactgtttctacttaactcatgttccattcagtcctttaacccgttgtaatgtagcttttgtcccctagcacttcattgatgggcctgtcacagaaacattgatgattttctggttggcaaatctagtcgacagttttgagctttatcttactggaacccttttgctacctttgacactggtgtcttttcattccttttggcactctctagcctcttggtttctgggccattagatttttgtagttctctcatctttctgaccttcctttactatcctctttgtaggctgtttttgtaccatctgcccctcaaaagttggtgttctgttagtttcagctttggctctctgatttatctccttgagtgatctcagctactcccatagtttcaagtaccaccaagccattaacttttgaggcttggtcttcagctcaaacctgtggtcctaggttcaggcttatatttatcttctgttggccatgtctacctgaatgtcacacagttacctcaaactaaacatgtccaaaactgaattttttctttctgctaacatggttctatattttatattctgtatctttatcaccatccacttagtcacccaaaccagacactcaggagttcatctaggctctcttttccctccctaataactcttattcaatcatactgattttttaccttcaattcctaacttaaaggctgaccactcatgtcttagacttccatgtgtcaattatggccttataagagggtgccatcattaagtcttgctgattttacctcccagatatttcttggattggcattctcatcatattctctcctaccactacccaggtttgagatctcattctactgcctggattactgtggtagtttcccacctgatgtccctatcttcaatcttgttcctttcaaattcaccttccatacaagcaccagaaagatttatttaaaattcaattttaggattacagttctgggtaagatatttaagcatctgttaccctttgtttcccactgaacatgatcataaaacccagaaagaacgcatggcaactcatggcgagtttcccacatttttttctctggcaacttaatccagtcagaaaccttgaagggagcactatggtacagacagaaagctccagaagaagctttctagttctggcttgagaagtgagagaaggaattcctaaagcttggggttggggaggtggaaatccccatctttttatttctctcttccctcacaccccaaccctcaggcaatcatacagcatcagcaacaatgatagcaatgggagccttcgagaaccagtactctcagggaatggacccataatctctatttgaggtagagttggggccccaagagagcaaagccacattctgttgattttttttctctttctgttctcccactgcttatctccagatgtggcacaattgcagacatgaacaatttctgactagcggacggaaagggaagtactaggaactggggagtactggggagaatgtggagaagtaggagctcaggaaagtgaccccataaagttttttttaatgtgctctttggtgtgtatcctcaacctgtatgtgtgttgatccagatcctaattagcatactaagaatttgagaactgagctgacagacactcatctaggttctagactgaccatttcatgacatgcacagcagacagatccagatagcactgcaaaggctttgaaaactgaggttggaccctcagcccacagaaggcaggtggaaacctgtggcctgaacctaatcagattgactgcaaaagcaaacatacattttccataaaatttaaaccagttctacaattttataatgtttatccaggatatactccagaattactaggcatatgaagaaccattgacatctcaacttgcatggcaaaagacaacagcaaggacaaaaagataaaggtgttggaattatctgacaaagtctttaagtctgctaccataaaaactcaaatgaacaattgcaaacacttttggaacaaatgttaaaatataaatgttaagctatagagtctcatcaaataggaattagaagagccaaatggacattttaggattgaaaaatacagtaactgaaacttaagacctcactgtgtggactcgagagaggacaaaggaaagagtaaagttgaaggtagataaatagaaattatgcaatgtgacagaaaaaagattgaaaaaaaaaatgaacaatgcctcagggacttgtaggacaataacaaaaggtctatcagtcatgctattagagccctaggaggagaggagaaagagaacagtgcagaaaaaaatctttgaagaaacaatggctgaaaagttctcaagtttggttaaagacaccaacctgtaggtttaagaaaacaagtgaacctcaacaggataaataaaacccataaatagataaatcatagtcaaactgctgaaaaagactaagaaaaacagaaatgatgcattatgtactgcatagaggaacaacaatttgaatgactatagatttatcatcagaaactctgtagaccagaaggaagaaacaaaatttttcaagtgttgaaagaatgatcaatccagaattcagtatctagcaaaaaataactttcaggaatgaaggtaaaacttaaaacacaatttcagacaaaggaaaactaagaaaattcacagcaagcgtatctgctgtaaaataatttttaaaggaatttcttcatatagaaatgaaatgatggacatagaaagtggaatgatagatagtggagactcggaagggtgggatgatgaaaaaatacttgggtacaatgtacattatttggttgatggatacactaaaatccccaacttgaccactgcactatctatgcttgtaacaaaattgcacttgcaccccataaattaatacaaattaaaaaaaaaaaaaagaaataccagaagagaaattggaacatccggaatgaaggaagagcaacagaactggtatctggctaaatataataaactactcttttcttaagttttgtaaaacatatttgttgattaaaagcaaaaattacattttgatgggattttcgatgtatgtaaatgtagtacataagacagtaatagcataaagtggagagaacaaagggctcaatatgctggtagggtttttacattgcaattgaagtggtaaaatgttgattctaagtagactgtgaaaagtatatattttgttatccctggagcaactactaaaaaaattacacagagagatgtcagagccacaatagataaaatggaataccaaaagttcaaataatcttaaaaaaaaaagcaggaaaagagaaacagagaaggaaaaaaaaaccagagaccaaacagaaaattttaaaatggcaaaccccaatccagtcttatcagtaattacattgaatggtctaaacatacaaatgaaaagacatattgtcaggatggattaaaaaagcatgaccacatgctgcctacaaaaactcacatcaaatatgatgatataggttggttaaaagtaaaaggctgaaaacaaatgccacttgaaaaccaaaagaaggctggagtggctatattaacatcagacaaagttgacttcactgcaaagtgttaggaatagtgatgttatatattgatagtgtcaattcaccaagaaggcagcaatcctaaatgtgtcctaataacagtttcaaaatactagaagcaaaaattgatagaattgaaacaagaaatgaacaaatccataattatagtttcagtaattgacggaagctagcagacagaaaatcagaaaagatattgaagaaatgaacaccattagccaactgaatccaactgatgtttatagaacactttaccaaacaaacggcagaatacacattcttctcaagtgcacatgggacattctccaagatagaccatatcctaggccataaaacaagttttaaccaattaaaaacaatagaaatcacagagtgtgttctttggccacagtggaattaaactagaaatgaataacagataaacaatagtaaaatcttcaaacacttggaaataacatacctttaatccatgggtcaaagaaactggaaaccacccaaaggacctccagtggatgaatggataaactggtggatccatgtaattgaattctattcagcaattaaaaggaacaaactgttgattcacatgacatcttgaaagaatatgaaaggcattttgctgaattaaagaagtctgtcccaaaaggttacatattctatgacattcttgaaagcccaaaaccatagtgatgtaaaatagatcagtggttagaaatagggttaaggtgtgattataaagaaataaaggagatttctggggcactggaaactgttctgtatcctgatagtggtggtggttacatgaatgtctacatgtgttaaaattcatggagctctacaccaaaagtaaagggcaattgtatgatcatttgaaaaatagacttaaaattcaattctgatggtgcttcactagcctacagggtgcagtacagacttcttaatatggattacagggcccaccccggtggtagcgcctcaacaacagggctgtttcccctcataaagcctaagaatgtagttttgggggtagactgaaatgtggtcccgaaggtcacaaatgttttgtctctaaataagacacttttcagtttggaaaatcaaggatttagaagactcaagttctcactctggtgtagcatgttgtggaatcctggcctagtatagcctcagttccctacctattaaacacgactaagaactggctcccctggggtcactattagtgtgacagaaattaaactgtattgaatgctcagccgaactgattttgcatttgaacagaatatggcttcccacctcaaacccctctggagaggagaggagtgtatgatgtatgcattggggggaatagattgtattgtcagatttcaaggtgccttatgcatttatttaacagtctggactacactctatcccactttgcctccccagtaactaatgcattccactgagatttgtatcctgcagagaattagctcctggagcaattacagtggcatgtatttccccacaggatcatccagagtcgcagctaggttttagagttcttcttggcaacccctttagtatcatgatcatccctgatggagattcttggtttgcgctgttgctgtcctccctcacctgccatcgtgacctgcatgtggcttgtttagagcttggatggccacccaagcccacctgccccccatttccaccaccattcaactccctttatgctgaggtaaatgatgaggcacggcattgattatgtttatccatttattaaaatatttaaagaagcaatactttattaacattgaggactggtgttccatttggcggggggagaggaataggcacactttgtggatcttttttttctgctttttcctgttaccatgtaaataccccagcttcctcccccaaccagcccctggccctgctgcttatttgcaggggcctctgaggaaataaaaaacacagagcagaaaacaacaatgggttacagattcactgacaaatagacaaatgcaattccacaaatcatatagccaagcaaggtctcatataggatggaatggtgctaatgggtttggttgctttggtattattttccacctctcgtgaaagaaaaattcttccatttgtgtcctgagggaagatgacgttgaccctgactgtttcttctggcccagttttattaaggtaaaaaatctctttcttattcttaacctgctcttatggacacagcacagggcctttctggagaaggggacccataactgtttacctcctatagtattgacaccagaagcagttggtggcagttcaaatgtatcggctttttcttctccactattcttctggccaggaattgcctacccaaccaattcgtcagaaagtgctaccaaagatacaaccaaaccctagagctttgggtcttaatgatgtctgaacataattgagatggatatttggtgtttggtcccaccacccaagcaattgtattaattactgcaagtggttaacaaagtccttaaaggagctcacactcccagagctaagacaactcccttgaggcatcacttcttgctttgtttccaagtgagcatatgcaagaacaggtgcttggcaagctatcttcctttttgggaaactactggtaacttagcaatttaggaggtaactgagggattgagcaagccacacctgctcctgggccttgtcatctatcaactgtgctccatgagctgactctagccccaaatactagtggtttcagtcaatatcattctgactcagagtgggaggacagggtaggtgaaagggaatccacatggcacaacagagcaacagcagcatcactgtgcacaaagacctaattattgcagcaaagtaagcacaagagatggagtcttattacagtttactatcatcagtgataaaaataattataagacacagccctgcttagtcactgccaagataaagctatcttctcccaggacttccttctgtagtcctaaatttgctcatttggacattttccccttcggaaaaagctcttctgaagaaaatgcaacttggttcccactctgtgagtgtgtgtgcaggtgtcaatgcatgcagccatagaggagccaagtcaggctgcaatagtgagcttgctgatttcatctaatacctcctcctgggaagaaagactaataacagagaaagtcaaagacacaacaacagcacactcactactcaaatatgtacaacaagctaacacattctgatgcttaaataagttttaaatgttttctgtcatctttttccattgactttcttctctagttgtagagctaggacttagtttggcacagcaatcagacatttggggactatccccttgttaatatttttctcctcacccctgcggaggtggagcacaggtggctggtttaagtgggttaggctggtggagttccagagttgagaaccagtgcttggaatctgaattgtgcacctcaatgaaccagccattggactgaatcaggtaattgagcacgctaagtttgtctgagaagtagggagaggccagttttctcttgataagtgggaagggacagttaactaaaggtatgagtcaagggtggggtgaagatgcaaggctgaccagagagaacctctctgggcattggggtttgattagatttgccctgactgggagaaggcatttttgaaaaatgtgaattagtatttggagcgatttaggaatagtttgttttcatgagaaatttgcaagaagaaccacaggaaagcacaggcttctagccttcatttctccaggcccatgttttttctgatcacttcaatgcccctctgtactcaagggaaaagggcaagatgggagatttgaaggtgacttgaggactgacccaacagcctgtccagaagatcaggccaagatggagcttgtggggaagggcctaggctgtgacttaattgtcaggcagtccctagttcaggcatctaagtcacagagctcaaggcctggttgctccatatagtctttttattggggaagggcacagttgctgatgaagagtctaggacagatagagcaaaaaaaggcagcatgccagcttaaaccccttctttagggcattggtgtttttgttcccctttccatggcctggctcagaattttaagggggcgtcagaatcagctgggccatagatcccagccacctctaagacgctgaaaatgcaccaaaagatttagaagctccaccaagaaatagggcagttggtagaggtgtatgtgttattgttatgtagagtaagggggagtgggaagggattcctggattagcacaataaattatagggtcacttagaggtcgagttgtattttcagctcttaaaaatatatatgcgtatgtatatatatatacatctttatgtctctatacataatctatactgcagcacagcggcaaaacatttagttaaaaaatccagcaagaatgcaggcaaacactccgtggaggcatgcaggctaggatcaaggcagcaggaggggagcctgtatggttgccatgaggggtgagttccaaccaatgagcccaccagagcaccacctggacatatgcagacatacaagcacacatagaaaaacgcaaagggtttgcagagagagagagaggttaccatatctacaaaaagagatttcacatggtcatcttaacaggaaagtggacaagcccccaggatctagttctcattttaatgagccaactagaagagatctcctgaaggtgcaagttgcagttggcagggattcggagagacacacaaccaagtctggctgtcctgcctgcccccttctcttcatctccctgggagtctgtgtgtctttcattcattccttagcattgatagtttctctgctggtcagagaaaaccattccaaaactccctgaagaggtgaactcccttgaatcctttatagatcccaggccattcataaagagcttatcccaataaatactgtagttgctcaagatgcacaaagagaaggagaactgaacaagacaactcggaacaagaacctttggccaatgaggaaatgtaaacctctaaggagaccagattaagtccaggaaaatgcattagtgaaaagaattggagggtctttcttggtggtgctcatgtttgttctgaaatgatttagtctagcctgtattgaggttttgagagtttttttagtagaattctcaatgttgtgagttcttccagctttcaagggctacagttgagatctcgatggtgttagaggatcatcaccctctgcttcatcttcacgatgtctgcggtgccataaattgccttcagaggaaaaaaaatggtatagaaataatgaggttagcacaatgccagatgcccaagtatgtggacccaaaagagagcaaaaagtctgttagaagatagactggtttgttcctattgtactaaccatctctgaatcatcagggaaaaccagctgaaaccaagtgagctaaagacaaatgggatgaattttcagaacctgataatttatggaactgatattgactctgtcagagtctttagaaatatttgcaaacactattgtctcccaattgacagactcttaaggaatcaaaccagttcgaccatacctgagaaaatacagctcgatccaagagattctctcttggcattcgtgcaaactcttagttccttgaaaacaaactgctaccctctgtccctttctttttttcttttttttctttctttccttctttctttcatttcgctccctttctttctccttccgtcctttctttattcttcctctttttttctccctccttccttccttccttccccctccctgcctccctccttccctccttcctctttctttcaagatgaggtctcactctattgcccaagctgaagagcagtggcatgatgacagctctctgcagcctcagcctcccaggctcaagcaatcctcccacctcagcctcccaagtagctaggactacaaacgcacaccatcatgccctattaattttttattttttgtagagacagcagggtcccaccacgttgcccaggctggtcttgaactcctgggctcaaacagtctgcctgcctcggccttccaaagtgttgggattacaggtgtgaacctgttccttttttttccatgtccactattactgcatctctcaagcttccaggttgtctaggaccaaaatttaggagggaccaccatttacatcagaattggcacaactgaaaactctaagagaaccttcttttgaatcctactgatatgtcaatagtgcttaaggccaattctgaagaaagaagaaatggaaccaaaattcaaacaataaaatatacagatatgttgcttttctaccacttactataacaggaacaaaagtgtttagataggccacagaacctgttcctgacccttaggagtgaatcaggcagaaaaatcaccgcctgtttgcatttttgttttctgtatatgttatggagaccacacaggttctccccttaccagtgtccatatcactttctctcaccttgtccaagatatggcttggtatcacttactgctgactcccagatggcctcccgcttcatcatcaccattcccacaaacatttctaatgggggcttcaggtccctgggaggtagccaggctgttgggggaagtcttcatgacccctctgcctgtgggggagacttaccaataaaactctggacactctggcctgatttaggcttgcgttcctcttctacctttttctttcccaatttggggaacttaattttcagcctgaggcttctactgtcagtgtccgaagatttttcctgagaaaccacaagaggaaggtcaaaatgttagttgcctaatattcaaagataattgctggagtcctggaaaagtggtaaacaagaatggctacagagaacagggagatctgctctctatccaggtatgagaaacacccccatcactggtcgcatgccctaggaaagcaattgatccttaccaagaggctacttgatgccaggtgctttgctagcattaataaatgctctcatacaactctcaaagcaaccttgcaaagtggttattaacatccctgtatcagagatgaggaagcagaagcttggagaggttaaatatttcacctgagctcatgtggctagggattagaaggatgagattgctagcgccactgctagctcacatggaatctctgcatgaattaggaaaaaacacctcttccttcagacatatagtttggtgagccttggccaaataccttcttatagggaagacccttgcctgccaggccagctgcttccctgtctggaatgcaaagagagttctctaaacataactcttaattatgaacttgggctctctgctgtgcagatcatgcaggctctgtaattccagcttaggcctgctaaagtatgcttgttttactactggtctcagtaaaacacaattttgagattaactttgttgtcagaaaacccagagtgggagggacggaaagcagcagggagaggtaatatttggaagatttaaccaccagtatggcctgggcaccaaccatttagaacaggtattggctgtaaactggcatggccatactggtatgaaccagatgaagttcagtcctggcagcaggtgctgagcagggagggggaatttgcagccaggaaaacaacacacaaaaaaacctatcttgcttattctttcttgatcatctcttgttacagaatgagccttctttctggttatttttccacagtcacctaatttttctacatgttttctgccttaccctatctatttatgatgaagagattggggggaggtgggcagggaggaagctccagtaaccttcagtttaaagccagcactggaccccctgtactacagtcaccatgtcctggcccacactggaagggaaggcactaaggaagaatccctctttccctttatttcccaattcccaagattacgcacctctggaacaaagattggattcatccagtcaatctcagatagctttttgaactccttattcatggcatccagggcgctttgtagtgcagtctcatcctcagcacttctcagctggtacagacaggaaaaagagtaagtgtccaatgcctagcacttttgtagactcttacactctcccccactcccagtccctgctagtgaccaagagaccacaaggtgccaacttgtatccctttggcccatagccagctgttttctttctcaaaaggaatatccagaaaacaaccaaatggtggggctctccttggggctgggcatgcttacagttttgcaagcagagaggtcttttgattagtatcaattaacactgagcttcacccctacagcttagggttgaggacaagggtcctactgtgacctccagtccctggagacatctcagtgttcccctaagtaaaagctacctagctttgagcacatactgtatgccaagcactgtacatacataattttgtcccatcttcccggtaaccttacaataccttacaaggtactattgttttcattccatgggtgagaaaacagactccaagaagtttagtgctcaagatcacacagctagacagaacccaggtctgtttaactgtatagcctgccctctatacaacattgtcttatcaaagacatgtggggaggccagatgctgagggaatctttattacatgcttactgtaatttaaaggttgttttgtgaagcaaggagagagctagagagaggctggctcaactttctcctcctggaaaagagggtctgtctccccaggccatgctttagcccccagctatcactatgactaattaagaaatgagttctagatggcttgtcccacaggttcaggaagcaaatttaagtgctccctagtaacccccagcgcccacaagatgaactttgtacagtccatggaagacttaaaatggattcttttgggaccatcttcgactcagaagaatcaagttctagaacatcaacacaggtgagatggttcacattccagtaagtagtgagctgggagaacagatgggcaaagatatcttcagccctcacatgcttacagcccacctaacctggcctcacctctactccctggcatgcactttactttcaatctagcacttatgtggcttcttgctgtgcacaggccacttgctgctccagccataggttgagccttgctggctgtcacaaacgggtggcatgtgaatgagaggagtacagggtaggaagttatggtcagtcactatgggatactgagggaggagcaagtcagtgccgacaaataatgttttttgcttttcaactagtaacttaagacaatacaaactgccctagatgcacgggacatgtgtgtgccaagtaagggaagtgggagttactgggagggattcacttcgtcatcaatttacttccctttactaactctgagctccttactgccctacttcttcaaggggaggaataacacccaaatgaaacaagctgtatctccatctcacctctaggacagcctttctggagatacatggtcattcttagctgctgcctgcttcttggccacatttggatgtgtggatgtgtatgtgtgtttaagtcctcactgggccctatgaggtgggagacttctcaagtgtggtatgggctcaagttgggttgttggttggtgtgaaccaattttcaggtcatgagcctcgggaaagtggcgacaagagaccaaacgcacctatttcctgctgcccaaatgggcaaggctattgagctctgcctatatatagaaagtacttctgttgatgttgtctgaggctcaaagactagcttggggctcagatgttgggacagtctgacctgattgccttagccactctgcctcctgtgcagtgtgccaattagatgagcaaatgaaaagaggaaatagatgcacttctgcaatatcaactctgaagcccctcttcaaataaaccttaattagatgagaggcaagcacagcacctgcctcagggccttaccagccaaccctaaagtggatgatcataattagtcacctcatcagagcacactcaccaagtatgcctatgggttttgcattctgagaaacatgcaactagccttctagcccaaaaatggagcctcagtctgttctccctagaactaacaaaatgcactatgaagctgctagtataggctaggcactgataggtacttaatatacaacaccctggagaggtagggattataattcctatcttgtagatatggaaactaagacccagagaggtgaagtcacacagctagtgttatgggttgaattgtgtccccccaggaatgacacgttgaagacctaatccccagtacatcagaatgtgaccttattcggaaatagggtcattgcagatgcaattagttgttgaggtcatattggatagggtaggccccaatccaatgtgactggtgtccttataagaagatggccttgtgaagacagagaaacacagagagaacatcatgtgaagatagaggattgaagtgatgcatctacaatccaaagaacaccaaagcttgccagaaaaccactggaagctagaaagaggcaaagaaggaccccttacaggttttagagagaggatggccctgctgacaccttgatttggacttctagcttccagaattgagagacaatacatttctgttgtttgaggacacctagttcttgatactttgttatggcagccttaggaaacgaatatattaatagctagtaagtggcagatttgagatttgaacccaggaatctcccaattttcccactattccacaccaccttctcatagggtgaaagaggcatgtagaaacttgggaggtacaaagcagctcaaaatagctcacctttttctactggagctgtatcaagtacggtaacactctactttttattggcctggtctgaacccacaagacatttaccaaaggagaggttgagactttctctcaagagtatggtagtccctgtggattagcataacccatgaagtcatacaaccaacaacaatcctaggtgacacagtagggacttccaggcaagcacctggccaaaatgctcccacgggtctccagtgcccttggaccaagcacaagaccatgaccatgttcagatagaatactttgccctcccagactccaaccccctgcactcaccagcttttcatccaggaaagctgtggtgtcatcgtagagacctttaagactaaatgtaacatctacggcatcatttctgcttagagtctgagaggaaaagaacggaaaaggagagaaaaagacaaagacaggggagttgttggttagtaagcatgcagctgtcttctccgtgggaaggtagaagcaggctagtaggatgtggctataggtgaaaaagcaatattcaaaatatagtacaactagcacagcatgagctgtactatcagaacgagtgccagctgacaactgctggtacagtagttgtgtagtactatgtgaagtggcagagcacggcttggctttggcatcactgattgattgcagtgggtataggaaaataggaaatatgcaaaccagagggtaaatttaaggctacttgttgtcctaggccaaaaccatcattccagggcaggtgaaattagggcctaacatctctcttcttgcaactccaggccttgagttgtaggcctcctccaactgtaatcaggccctgacacaattatatctttcgcctagcactaaagttactttttaaaagcatcagttaacaattctggcagtggacaaagccatggggtgacacatttaacattaagtgtcctgcctgatatggacctttccctcaagaggaaaaccgaggcacccggaagttctagttccaatgacaggtgttcccttatcaggttatacagagatctacttgtgataaggaagggccaagtacaagtttctcttcgtttattgtccatttctcccttgaagctggtgggagggatggctatcagggaagagggctagctctcaggctgatgaaatctgctgtgattttcccccagcaaccaccttggacctgtaacaagtcaaggaatgcctgccttcccgtccactctctccatcagtttcctgccatatttgcccagtttctccgtccagcctccggctccacttctttccctttcatcctctttcctatctggtttgactcctttccttaattcactcctttctacttacttcaatgggaatacaggaagctgcacccatctcattgccactgtcttggccgtaaaatatatcattcaggatgttagcgctggcattcacagaacccatgaggacagacacatgctggtggatcttgctcaggtcattaagtctgtaataaagcaaggacagatagatgagttgggatttctgaaggacttctggcctggggcactggtgagggtttgggtaagggtagaagtgaaagccctgggtacctgacttggactcatgactccctcctgttatttctgctcttctctaggtagccacctatgctagcaaatgtttctactcttctctaggtatttacctttacccatccttgtctcacctgaatttagatattgggaatttggggagggtagaaggctagaacagaggagggcagctgactctaggaactccaaggccctcctgatatttaagggcaagggtaaacagtcttagttctattgggtttggattagcaacaagagatccaaattaatccctgggtctaatgagagatgtctaacctggcttattgctgagcacagagaatatttcctgcctggattgtgagggtcccgctcaatttttagagctctaagctaaattcctctctgaggccaggctccctagtagccaatagacacaaattggcttcttctccctatgccttcttaggattctcagccctgtatctaggccagtccacttacttgctgatgaggttttctgcaagccgagctaagtgctgcatctgggcatactcctcgtcagagaggctctcttgagagtcctggaagtccagctggggttgaggggcagcttgaatttcagtatgcttgtattcccacattttcattgagttctcaaagtcctggagatgaatacagtggcatatcctaatgattgctgtagctactagtgcacatgacagatctgtctgtgagcctgacgtttgtgggcaatgggtatgtgggtacagtgggtagaggggaaggagggccccctgtccattccccctgtcatacccatctatatacctatacaagtatccatcattttattcaatctcttctggactatgccctttagtttttgttgttctgagtatgctggattttgggacaccaggcttggatcatacacatgtctggtttctagaagctcccatatgaaggcatcatgactgacaagacagtggagcacctttcatgctcccttctttgccaaatgtaggcaatatgtggtgatgcagtttagagccaaacatatctaatttaattttgaatcgtgtttctgtcatttactagttgtgtgaccattagcaaattatttaacctctctggtcctcattttcctcatctgtaaaatgggaataagtgtatccacctcataagattgtggagagaacctacatgagagaaatgtaaaatgcctagcacagaataggcagtttataaactggacttctcttcctttctctattgctgtttccatggacttttcacaggttagagtgcaagataacctccaagcattgaatatgtgatcaataatagctcctttataagctttagaagctttagctgaagtggatgacatgtattaatgcagcattttaaggaaccttagagacacctaaagaccatgttcaatgcagaatctgttgctgaaggagaagatttttccataatcatctgacgcttttagctctctttgcagtggaaagaggaggataaccttgtcgaaaaccaggggaggaagctccttgtctcactctcttggacagtgtttgcaaatgtcagtatatatcagagtgtcttgaggagcctgtttgcaaatttgggttcctgggaactatgcaaccctatgtggttcagtgggtctggtgtgggggcccaagaatgcatttataaccagcatctcaagtgactctgatgccaggggcacacagacctccttttgaggaattctgcttgagtggaaatattcagtactcaagtgactatggatgaggcagtataggagcccaagacaagattttcccccttacccgatctcttgtcagcatctgggcagcgttcttgtatctaattttgataagcctggtctctgaatccaggcctccccatccacctgcactgggataccttcttcaccatcaatggttatcatcacctcatggcactgccagagaaaatgaggaagaatgggagagaaaaatggggcaactgctgtaactctatctgataatctcatagttatggccttgaatgtgtatctgaagcaggactggaaaggatgtgaatcagatcatcccaggaagaaatgcctgtttcctatgggctttttgctccattggcttctgccacctctgcctccaacctcagtcagcactttactgcccaccagataacctgctcactccaccctggcattcttctacccagttaattcctgggactatcccacatcctgggtagcagtcaaaaacctcagccccttcccagtgcccacccagcccctgcctacctgggcaatgcgatgatgatgcaggttgatgatacgggacattgccatctgcacagaaccaaagattgccaccacctccagtttcccatcatcgattgcaggagcctcatattcctgaggaggaagaactgtgtcacatctcccacccttgagaaatcacaccctgtctataacaagaaggcatgtttaaaggctcctggtgagaatttttctagctcatgaagagtggaaacacttcattattaaaagggaaaaagatgaggtcagaaagccaatctgggaaaagggtactgcactcttagccagttccctccttttccaatccagcatcataaatacctgaggccagtcttattggccttatgaccttcttgggtaaactcagagtaaaggggtcatggtcagcatcccaggagattttactgacagaattccttggagaaaagagcatggccttggccgggcgcagtggctcacacctgtaatcccagcactttgggaggccaaggtgggtggatcacctgaggccaaaagttcaaggtcaacaagcctggtcaacatggcgaaaccctgtctctactaaaaatacaaaaattagccgggcatggtggctggcgcctgtaatcccagctactcgggaggctgaggcaggagaatcacttgaacctgggaggcggaggttgcagtgagctgagatcttgccactccagcctggatgacagagcaagactccgtttcaaaaaaaaaaaaaaaaaaaaagcatggtctagatagcctttaaaggatctgtcagacccgaggaatggaaaatccaaagcccaggcaacacctacgagttgaccttatcctgaggtctttggttgaattttctgctttcggatggtaattgcctgaaaaactgatcatacagctgctgctaataaaggttctcggaccacctcctcttctcccattgtctatttttcacttcagttagcacaatgcttccttcagagagaccttagtgggatcatgcctttcttcctccccattccttgttccatactaaccgtggttgctgtgttgcttccccagaagttgatacctccagcatagctggtaatgttgagcactacaatgccttgcaggtttggcaaggagatggtttctccatcacactgaaagaaaagagtagctctcattagctggatctttagatagcaacatgaaggaacatttacagagatggggaaagggctctgtcttctcttccattacatggaaatctatcttcatgccttcctcccatgagctgtgaggatcacagagttaaagctcaggaagaatcagcatgtacggtattcccaaggccatgagatttcctttctccatacccaggaaagactacccgcttttccactaacctccaaatgcactcgttcttccagtttcctgtaagagcgctgcaaaagttctttggttcccagaaggccataccacatcttgttcttaaggcggctactacatggaggtaagcattaagaaagcagagggtgaatgatatatagataaatggtggaaaaagacaggaaggaaaaccatcttacttctcaaatgccttcttacagagaggagtcatgctaaatggcaactggacagcggttaatgtaactgatatccaatgcaaacacttgaagaaatgggttcctgggcccctttgaagcctcagtatcctatcaataaataaattttccatttctgcttgctaccaatattggtccagacttggaagaaacaggctatattcagacatcaatgctcataaaaagctatgagcgtagctggctggtacacaccagctaccctagttgtgctactccaggagatttcagctgcttggaatcaatttcatttgaaacacgtgactcttagagtgcaattttttttgaagcagcaacttttctggcaaagtgaagtacttttccaaacaccagatccatatactaaatgcctaattcaatgccatggaacagatctaagcttgtagggagattttagaggaggagccagtggagaaaaataggagacaggaaaggatatcaggtgacttgaggtggaggtggggaggacagcgtcttgttgactgtggaatctctgatagaaataggtggggcacttacgatcactagaaaggctggatatagtttacttggagcttgtaaagtagagccacagaaatgagccatcatcacatggaatgagttttgaaatgtcagaaggctagcacaaaattattgagacactgtttaaaccattcattctctgggcactttggtgttctcatctacaaaaataggagtttaggtatatgaaaatgtacaatacctagaacaaaccaattctgaaaaaaagaatcaagtgggggactttcatctcccaatttcaaaaactactgtaaagctatagttatcaagatagtgtggtacttgcataggatagacacataaataaatagaacagaagtgagagtccagaaataaacccttgcatttgtggtcaattgatttttgacaaaggtgccaacacgattcactggggaaaggatagctgttttgaaaaatggctctagatccgggcgcggtggctcatgcctataatcctatcgctttgggaagctgaggcgggcggattgcctgacctcaggaattcgagaccagcctgggcaaaatggtgaaactccgtctctactaaattacaaaaaattagtcaagcatggtatcatgcaccagtagtcccagctacttgggaggctgaggcaggagaattacttgaacccaggaggcagaggttgcagtgagccgagatcatgccactgcactccagcctaggcgacagaacaagactccgtctccaagaaaataaaaaaaataaacaaataaataaattaaaatggtggtgagataattagatatccacaggcaaaaagataaacttagactcttaccttagaccctcacactatacgtaaaaattaactcaaagtagatcatacacttaaatgtattaataagagctaaaacaatacaaactttagaagaaaacttaggagcaaatttttaagatctcagattaggcaaagatttcttacagatggcaccaaaagcatggtccataaagaaaaaaactgatcaattggaccgccttagaattcaatacttttgtatttcaaagataccactaagaaaatgaaaagaccagcaagagactgggagaaaatatttgcaaatcacatatctgacaaagttcctgtttctcagcccaggcctgctttgagaaagaggttctagtggtggtggcaagggtggggtgttgtggggtggggtgtcacactttttacttatagcttcaatgtaccacaagaactctgagactgacttaggccttgtctgaagtatgaaagtgcgagaaggtgccatgcaggccaacactggatagggtaaaattaacgggttcaggggaaccaggttaggaacaccaaaaacaaatagagggatgtttgatactttgcaactttgtcaagtgaaaacagatctgaagccactactgaaacctggttaaactttcacagacagaacaaaggtgggcgatttgctaaattgagtcaacataatctgttgtcagtaacagtaacacaggtagctgtgtttacacagaaatccacaggtctggatttgaaggcagctcaagtttaggatgccagtgcagtcatccaaaatttggcacacactgtcccgctagactagtcttggggccaatgcattttacttccagtgggtccctttctttctgttgcttgtctgagaggtagagaatgtaggaatacgtatgtgtattgtgatagtgtgtttgcatgtagggaagggagtttcttttccttacttgtattgccctgggtgttcatctcttctggtgttgaagtccagagaaattttagcatccagtccaattccgaagtagttgttcatgacacatttttctttgaagcgtctgaaattattcaaagaagaggacagacattggtgcaggaaagaagtgccgctatcaattgggcatgaagatgaatctgcatgatggaaaaccagtgagggaaggccccctccacactgggcactaactataacatttttgagaggcacatgtagatatccttttgtgtgaacaactagcttattagctgtaagagggagtgcctcgccagttgggaagcttcagtgggattggaactcataataaagaagcaacattgatgattttagtcatctttggaggccttatgtatgagtggcccatattttcttcatatgtagtattaagggaaatactgtttactcctataaagaacttttgaatatcctagacacaaacgtgccatgacagttaagtctgcacaactgctctcagtgatgtccgacatcaaaggggaaaatgaccacacatttggaaggaaagactgataaaagagggtagatatgtacataacaaaaaagccaaattatttgtcaagtctcctgtgtccatctagggtgtcagcatcaaaaccagtggtgtgccatagccagttggcaccagctcatgtaaactgattatgcatatctctttccaactccagattcaatggcattatatcactaacttaaataggccatggtggaagggtttacaccataaatgaatcagggctttctcccccaagagaggaggttgttaaacactttgccagtgcactattgatcaaaattcattaggtagatccatgagagctcagacataaatttgagccaatggtgaagtgtgggggcaagaatgcgggttggagacaggaataaaaattgttttcttaaataaattatttaagaaaacataaataatttctagctgtgtccttttgagaaattaaatggatacagtttagctgtttaatcttagattacttttttattcattaccatactgaccttacatctctcacatgagatttgcctccctcaaccacagtccagagattggagtttctctaactaatgtccaaactgatcttcttaatggaactcagaatgagtgagtgtggcagaacttggctgctgccgatattctaaagagggagaactggtgagacagatgtccttagatttgctgcctagtcccctagtgaccattttagtttttagtatcttcaaccatttactgttaagggcaacagtgaaaaaaagcaagtcctctgtaataacaacaactaacatttattaattatttataataataacaataataactgcaaatgcatataacacttaattatgggtgccaagcactactcagtgcaagtacttttcatatataaatgtaataaatacagcaaacccatgatgcaagttctacaatggtcttcattttacatatgagaaaactgaggctcacactggtttagtcacttgcgtaggtgacacagctagtaagtaagagaaaggatttgactatggatatcctaagattgtgctcttaacaagagaaagaaagaagccattaaaaggtgatagagttaaatacttacatagattcaggtgtaaaatgtaagtgatccaagttaaggttgtccaggtcctcacttttgagagaagatatagaagacaaagtgccacgacgagaacctagacacaaaagacatcacttgggtgacggatacaaacaaaaaagccctttcccctcacttgtatttcgccctattttctctgtggaggcagggtcaagctcagtgactttctcctagataatattaagggttctaattccaaagagggatcctcttggatggatagggacttccactgagagaagaataaagctgggctgcttgcttgctggcagtgaaaacaacttcaaatcttgtatttcatcaggccagcctcttcaatgttcctaatggggtcattactctggacattggcatgggatcttatagtgtgagtttctgggaaagacggaggggtatctactgcaggattatggctaaaagaggatgcataaaaaatacatatttattctttgggagctaaacaacagtgacgaaggctagaataagggaagaagacagaaagatccttacggcgtcgtgggcttgtctggttaatatcttctgggtcatcttccaggaagaaagttgaactaaagttcttaacagatattgtctgtctgctttcctcatccagagctatagagaaaagtgggaggaaggaaagcaaaaaagaaaggaggaagggagggaggaagaaaggagggagggaggatggaaggaaggaaagattaattacacttattgaacatttatcgagcatctattttgtttagttagtgggtagatgatggagactcccattcgaccatcacgtctcctccatgatactgtttgtagtctcagcttgcttacagtgttgctgttttttcatattcatgcctgagctttctttgttttactggttactcttttttctctcacccagtacatgtggttgtgagtagaagcttgtggctgtggattggggtatcagcatgggaaactctctgctcttctacctccattctattagttcatttacttatgtggcttttgtctataattgagcctctaggactgtgccactctttcactctaatgtctcactccacacctggaacatttgggaagtctctttcctttcaccagccaaatgttgtatagctgagatgcccagtctcagcctgtgtcaaagctcataggttcaatctctacccctaccagggaggtattttcctatctcatagccacaagctacacctctaaatctaacatatgtgttgatggagcagactgagggttggttgcgacagttatggctacatccgtttaatctgatccacactgcttggaaactaattatagaaatagaggcaaattgattgtttaatccttccactgtgcagaagggagattttctttctttctaggaaacttggctgaggttgtacgtgaaggtaccaaggcagggcaaggcaccatggctaaaagtcaagggccagccaaagggacttccttgctgcatgggacttctgctcagttccaatagttcagttagaatacactcattcttataccaccttctgatctgtttctcaaagtattgtgggaaagaagtggtcagcaaaacattcaatgaagaaactgagggagttgaagagttttcattctgagttgggaagtttgcagactgtcgtgagttctgagcaatggtaattaatgctagaactgtcaggaccactctcagggcccttgtgcctgattaatcatgtgcaacacatgcagagttgaacaccattttctttctaaaatagtcataggctcagtggttggaaagaaacaggagaaggaggaaaaaagtcttatggctggtggtggaagctgatagagctttgaaccaggtcacttagcatctattaatataattgtataggatgagtgttggtttccaaaaatgagtagcaggagttgactgtctgggaggtaggaggagccaaaggggcagcttagcaggactgaggcttttcaaatcagtagtctgaatactgactttgtatacaatatgaatgcagaatctagactttttgtagcagagtcagagagcaaacccggagtcagtgaggccagtaaaccatcctctggaactttttctttcccctacctcagtcactacaaccctggccaccttaccttgttcaacttgaaatatgatgagtttcaaggatttctggagactctgggcctttgtagccagctccaacttgcacttggctatgtggtctatttgaggaatgaagggcttcctatctgccttgctgctgtctgcatattctgtagcacttttttcagcagaagtagctgctgcctcctcagccaggacatcgatcaggacactgagcctatcatacattaagtcactctatatagaaaggaaggagacagggcattgttatgagggacccatgcttgagaggacagaatgaggagtggtggtgatatggggaagggtagggaggggtaagagttgtccataaatgctgagcatagaaaaccacatgtgagaagatgaagtacttagcaaaagaagtaggtgggaagatgtgatgagataaccaaagggtgttaggagatcaaacacatatcatttgtttctgagtggccccatgcatcagtgtatatagctgagtctttcttgtgtcaaacgggcctataaaacaatgtataacatgcaaacttgaggaaagacaaatatttctggattttcatgggcacgctcctctggatatgaacgtgtccctgcttgggtgcttggtgtgtgtctttgtatgtgtacaggcttggggacctacatctgctgcatgatttaaggccttgattcttagctccatcacttaatagtttgcgatctgaggcaagtttcttaaccgctttgtgcctccatattctagggtagttgtgaggaataaatacattaatacattaaaaacagaacagtccttgacacagagtaagtgctatataaatgttggctattgttgttagagaggtaaatgtgaatgtatttgtagtgtgtattcgtatgtacatacttgtaagcatgttctggtgtacaaccatgcacatacctgcttgatgtacacttgtgtctagttgtgggcagatgcttggcatgtacatggtatgtgtgtatgcatgcagagcgccatccttcatttagcaaaagatggaagttcaatgaggttagaccttcctcatcagggaggcttaacagctgcccctcctttcctttcttttaccattcccagtgagaggcatgtttgctttttattaaaaagggcccctggctgctccacaaagagtataagacaaaaggaatgggaacttactttcaaaatcacagacactattgcagtgttgttctgttttatctgaccccaggcctttacaatatcaaccacaaaatcttccacagctgaacacaagaatctggaaagataaaatagatggcacaatgttacatgaaccatgaggcccagagcccttctctcttatgtcatcagtccccatcctcctcctctctctctttcctgatctgtcctctttctctcaccctctgctcccagcctttttctctctgctttttttttcctgtgcatatggtgaaatatgttccatccccactttagttcagtgtcacaccacttcccaagtcaagaacctaatagagcttgaccagcatttcttagtactaattctgaatttccagaaaagagaattcacttggtccaacttgggtcaggttttcacctaggttcaatcagctatgtttcaagggcccagctaatttagtacaaacaattatattgggaggactctccctgtgggaagtttttctcaaaggagagtgtagtcgactgggcaggagccccctaagaagtcccagaagaaacaaatgacccacatatttagaagggggaatgtgttcctcaggttatgagaaagcagctataggcagatattgcagagacctttcttaatgtcaaagacggaaagcaaggtgtctatactatagggagctatgctatgctcctaaatggtctataatgttgtgtttccctactataattctcttcccaaatctctggcttgcaattttgactttttggagcagcagacgacttcacctcaatgtcatctttctttcctaaactttccattcagggggtttgagttgggagaaatctgatttgggaacataaacatgtattttccttggcctcaacaccctcagctatcaaaatgagccccatgtctgacctgggaacagccccaaaggatgagagccaaaggaagactgacctggttgcgatgatcatctctgtggggtacttggccttcaggattttgttcaactcggtggctgcagattctaagtgttggatggcagcagcctaggggcaaaaggagttcttagccctggaatcttagtacaataacacagtgtgctgcccatcctcatcccctgcagcctcattgtttcttactgactctacccgcaactcaactgcctctctggaaatgataatgatcaaagaattcttgttgaaggtcaacagagatgatcttagatctatgcgtattctaaaaatttagatgtatttcattttctcttaataatcaaaacctcatatgaaggaggtactatttctttcatgtttcaaatgaacaaacaatctcatattacatagctagtaaggaataaagctggattcgaatctacatctttccaattccagaatgtaacttctttaataatattactaccaataataacagcacccacttatatagtactgactatgtgccaggctctgttctaagctacatgtatattttttcatataatcctcataacaaccctatgagataaagactgttattatctccatttcacagaagagaaagctgagcccagagaagggaaagatgataaattgtagagccaggattcaattccaggtagtctggctcttgagtctgtgctcttaattacaacttctactccttcctctctatcacccttgacattcaaacatctaccaagacttgataattctattttttgagtatgtctcaaatgtatccactgctactcatccctgctaccacttcaccagtccaaatcaccatcacctcttgcctagacaattacaacatctcctagcttttctctttgcctctagtcttttattccttcaattgtttctccacataccatggcactcctctacttaaaccccttctcttagatagcagactggatagatgactggatatgtgataaagcacgcataggaaaatgttagtagtagagctaccattttaactttcatcaatgtagaaattttcataataagataagaaaaaaatcttctgtaattcttattgctcttaggatgaaatccaaacttcctactgtggtttatcaggccctttctggcctggcccctgattacttctctagcctcatctttagtcactctccctgaatgcccccttcctggcccctacgcctcagccattatgaatgtacttcagtttcgtgaatattccatgctctcccttgcctttggaacaatacacgctgttccatctgtgtggaacagccctcccctttcttattctcctggttaattccctctggatctcaagtatcttgtgaaatggcactccttctgagcggctttccctgatttccccagactgagatagatcttcctgctatgtgttcccaaccccctctacttccttatatactaacactcatactacttgattaaaacaatttatttttccatctattcaagtagactatgtcattcttctttacccagtagcatataagaacatctcctagaataatatctcacataaagtagttactccataaatattttgaatgaataagtaaatgagtgaatgaattatatccccagtgcttaacatagttcttggtaaatagctgctgactgacatgtcaccaactctcaatgatctcatcctcatccatgcacaatgcaaaagcttctctctgggttttgccaattatttcactgagtaataaagatattggtctgaattacagctgaacagtagttacctcaaatcgtggtacatccatttcaacctgtccttttagcagcggggtttgtctgggagtctcacgaatcatcacactccatctgaaatgaatttcaaagacggatatttaagggtctgtttcatgactggtaaaaattagtgcttcaaaggtgaagacagaagtaaaaatgtttatgtggtggggggaggtgggttgtagggggtgtccaagcaatctctggtcacctgatctcaaggtgaccataagagggacctctgtctcatgacttctgtaggccagtgtgatggaaggaattgccttccctttacagggttctcagagagcagtgcttcttaaccagaggtaaccatcaagatcatctgaggtgcttttgtacaatacacattccagggccctgccaagacctactgaatctttgtggtggggttcaggttgatgtttttaaaaagctccccaggagatccttatgggcagcaataaatcaaatgctcctatatacaccagcatagaaagtctttttttcctcaggagataggatggtagtacttgctcttctctagagcagtgacaatgtaagcaagttatttctaaactctccctccatcccttttttagtttctttgaaaatctgatgaaattatagacttttccccaagagagaatatgcttaaacagatcattggctctgcaatttgaagagggttcactgaacccttgaacgttatccatggggcccctgctctagaatcgtctagtttttttggtgtttttgttgttgttgtttttgttttgttttggtttttttgagacagggtctcattctgttgcccagactggaatgcattggcatgatcatggcccactgcagccttaacttcccagtaggatcctttagttttgaagaggggcttcaatgtttgaaggatacatggtagaccctggcttcccaagagacaagccccacccaacccacaaatggctctgcactgaagccagaaaggaaatgaggctctatcaatcagagaggttaaagtattcctgattgagatgatgtgagtgatgtgggacaggaagaggcacaagggcctggtctttcagccacttacctgtctaggatcctcacactagcctgctccactctgttgaggatgtccagaggtgacttgcttttgttccagaatgcaccccagcccagaacacgagccagatcattgccggttccaagtgggatgactgccaactgacactgcaagaacaaaaggagacacccttttcagacagtctttctaccaagcttcacccatgaaggaacccagagggtactctttgggaagaattatggtcttaaaaccagtggatttacgggacttcagattctggggaaggtaatgagaggatgtttgcaattgggtgaaattttccctaaggagttggaccccagtgttaacaacacagaacctactaagtaaagggaaaagttgccggaatatgacaatattcatggccatgcttaaagaagagaaatatagctgtgaatttctatctgggctgggccaaggaggtgaagtacgtcaggagacaaagctactggagtgagaagagcaaggcggctgcctaaggacagtaaggagacatagaggaaactttctgccactcttgagactcaaggaagaaaatcagtgggttcaggaggggaaggaaattgggggttgagtgctgtctaagaccacttctgttttgtttgctctcctccccttcaattcttcactttgaagcctagggaacagagcactgctcgttctttctgtcgatgtcacacagatagacaaccagaaaacagtgtagatgagtaggcttagattgggaatctaccagtcaggctgaatatgaaacctgggggaaacatattttacagacagggagggcgaagacttgggacttcttgggatgggcagctgcacacccctactctttctagcaatggctaaactgagtcatccagggacttaccttttcatgtaatccaaaggcatcaatcagagataagacccagctcacgctgccatctccaccacaaaccagaatgcgaaagcgagcaaagttcttgaacatagacagcctggaaggacaaagaggaaagggggtcatttcatgaacagctgggttttgtaacttttcctacaatgtgtcaggacacaaggattgctgctttggcactctgctaacagaccacctgccttctttcccttagcccttatctgtctgtgggatctaagaccatagaccatcccagagatcaggctttgcctcaactcattttctttctgtgcctctggaaaacactagtaacctaaacagacccatttgctgaggcccaggaagatgccttgcatggtggccagtgggctcacaggaaccaggactgagcagccagatggtcccaaaataaaacaggtctatagaggagatatatctatttggtcccgggaaagagagtggcaggaaaagtagacagcagtatccatttgtctctttctctcaggttaggaggcatagttttacgttttccaaccaaaaaagataaagcaaatctgacaggggcttggacatgggcttgaagggatttctgggagagggctaagagccctcctaccagccaacccaaaaggctctggagttatgtgcttgtgtcctgacttgagaaaatagacctttcctgcccaaatacaagaactgattccaagaagcctgttttagtttagaatgtatagaaggaagactcccttacatacccaatcatatccatgggatacaggcttaccctgcttcaggtccacccttcaataagtcgaacacttgagatgggttaaggtattgcttgaattttcggaggaagacgatcccctgatgatcgccacttttggagttgatgaagatgagcaagggacatgaacaggctgatgaccaatcaagattccagaagtctgaagatactactaattggcctgacacaacgaaaagaaaaagaagaaaaaaaagaacggacccgttgagatggaaacgagacatgacttaacatcacattttgcaataactttttgagtatgagtctcagtcttttgaaaatgaggagcagaggaaaagtcaagataccacccagaggggcttaaaagtatttgttgtatttgtctagctgttgtcagacaaatgacatttgctgagccactaccacatgccaagcatcatgccagatactgctaggggtatagtccctgccttcaagctcaggagagagactcatacacaacagtatgttggaacataaggaataaagaaattggtgccacaacaaaggattagtaaaactgtgaggaaactgaggaaggagaggattgagaacccaggaggaagaccagcacacaactagtcctttctctgcccaggatacctcagttcttatagtgagaagataccaggtcaggagagaggggaaggaaaggctgtcatttagccaggagctaataacagaacgtatcaatgtggggtgaagcaaagagctttaatcacttctctaaggctgttgcagagcaatctgtgttatctcaccaacttccctggggaaacaagactataggaaaattatctgaacaagggagaggcttttaataatctccaatattgtagttacccatagagaagtagggttatagcagtctaaataaccaaagcctgccagctcgtgctgagtctcagagcctgttggcagggagacaggcagtgtgcaatggcctcctaagagatgctagacaaatagtgagcccccagacctcggagctgtggcttgacagggatgcctctgcaaaaataaatacacagggcaaaaagcatgtggctcactcctcagtgggggtgggaggaggtgggttgagaagacccatttgttttagcctgggtgaaagggagcctgaaggaaatctacttgagcagatttcataactggtttgcctggaaaaatcaaaggcaggtttcccctatgggccaattcccactcactggccagtggagcttgaaggcatcctaagccagctagccagtcatgcaccaaatttttaggacttgccaggactcacagctacaaggggagtcttgtagaagctgggtcccctcactagcatagctcggaagtagttactttccccgaatacattatccaaaagtagtaccccttccaacatttttttactaaagtaatatgttgacacaatggtagttaagacacattaatcccttcattcaataaatatgtatggagggcattctctgtgcctgctttatgtcctgagaatacagtggtggacaagatagaaatagtctctgcccttgtggaacttatattttaatggaggagacagaccataacaaagaattataaaaaagaatttgccatgaagaaaaataaggtagggaaagggggtagatattggaaggggtgttattttagacagagtgtcagggatggcttctttcaggaggtgacatttgagatgaaacttgaatgaatgcaggagtgagcaatgcagggaagagtgttttgggggtaggaagaagaataagtgccaggaccctgaaaagggagactgtctgggctgtctgaggaccagtgaagagaatagtatggttattgtggagtgagtggggggggagtggcagaagatgaggtcagagaggtgacatgggacagatccaatggcaacaagatgttggaggaagcagtgcaaaaataaggggaagactgttcagcatggacttgagacgtcacgagtcaggtcttaagatatttaaagaaagtagtcaaaaggtgttaactttttatgtgcttgctcccctaccaatgaacaatgcaggccccaattcatggcctagccccaagcttacctctcccttgttttagaacctgtctgtgctctgtgcttccctttctcactctgcaaccctctgtcaacaccctctaagtgagcatatgactttgggtatgcaccctaattaaaggactcatggaagcaacttcttgccaacatctagtggctctctgaggtgtgcttggaagcaagcactttccctgccagaggtcctggaataaacctatctatgcccccaaagtttttgttttgtttagtgtcaaaggccctttgggggtagttcctctctaaaggtgagacagcagtggcagtgagaccaaccactgtgtactatttgggcctcagtttccttatcttcaaaatgaatcattcaaaaacttaaattagtttcccagtgtttagatgaaaatggacctttaaaagccaatcattatgctcataatttggctcctaaagatgagaagatggtcaaacttactcataacaagaaatatacagattaaaactagcctatgttaacatttttttttcttgtctagaacattggcaaaaaaaaaaaaaaatagataacacacttgactggggaggccatggggaaataggcactctcatacaccaagaatggacgtgctgagtgacacaagccctgtagaggtgaatttgacagtatctatgaaaattacagaggcatatgcattttgacctagtaattccatttcttggaatttttcatatagacgtgtatgtaaaaggatatgcatgaggctgttcactgtggcattatttgcaatagcaaaagactgaaaactactaaattattcatcatagtggactggttaagtacgttatggtgtatccatacagcagaatatcttgtaactgtaaaaaagagcgaggaagcaatttgttgataaggaaaagtctccaaaatatactgtgaaggagaaaaagagcaaggcgcagaacaatgtgcatagtattaaaaggggtggataagaatatctatttatatttactggtatatacatgaagaactactggaaggtatttaagaaactaatggcagtattgaactgtgagtgaggatatgggggctgtaggagattgagaagatcagagaaaagatagcagcaagacttttcattaagtattatgtgtatatatgtatttcttttttaaaaaactgaaccatgtgaatatattaactagacaagaattgaattaagaaataggaaaaaagaattatgctaatgctgtctataaattaaatagccatgagggtgtaaactagagtgagcataggaagcttagggagaaaattctgtaattaaggcaacttgaactttaacatcaaacctcatctgtggatgggaagacagtgggacatagccccagcaggaaggcagtcccaggagactacaggggcagctccatctagtatttccccctgaggaagagaatatctgaatttcagcaaggccaagtttgtcaagagaatcttgtgaaccaggtgacaaagatgggtgccactgagggcagaaatgtaataatgttaagatttataaccaggcaatcctttccacaagattgcttttgaatagactgatgttaatcataagggagtgcccagtattattccacaattttaattgacaattcacatggaaacatagaagtctggcttgtgaactctgaagtactcaaagctggaggaagagatacttaatgacagaatcaagattgaaaagtgaccttgacaggctgactggtcaaagtccagggatgaaatgtaaagggaataaatgtgaagcttgccctttaggctcaaggacataaattgtaccagaacaggacaatacgaacttgacttggcagcatcaagtgtgaaaagagcttaggggacttagttgactttaagctcctgatgagtcaacagcctgaaagaacctttcaaaaaaagctcatgtttctttgagctgcattaatataaccatagtgccctaaacagggagccaacagtcccactcaaattcattctgttcactccaaagaaagatgcgaaattggcataggttggcttaccattctcttcccgtacttttaaaatcctcccttacaaatgtcaactcatttaaccttcatgacacacctgagtacaattgttattccttattggcagaaaacaaatgccagattaaccacagagaggttaagtaacttgtccaggggcatacagtaaatgatagagtgtgtttctaggactagtagtatcagcaacatctgggacttgttagagatgcaatttcctgggccccacccagatctactgaatcaaatgctctgggggtagtgcccagaaatctgtgttttaacaagcctttcagatgcttctgatacaacaaccactgcacttcactattttttctccatatgagccagtgatgctatcttagtcgttgctcagcattgagccttacatacaggcagtattcagtaaatgtattaaggaattcatgtaacaaatcttgactgtgtgtataccgtatacccaggtctgagtcaagtgctaaggatacagagagctcacagtctggggtggaagatggacaccattataatgtcatgtgttaggtgctttgagatatgtcttcttggtttatagccatagaagtaattgatttgtttgggagagtgggaagaggccattacagaagctgtcaaacagagaagacaatgtttaattttgagctggaccctaaaggataagagaaggaatataccaagcagactggataggaaaaagggataattggaaggaattctcagaaattagagtctactgactgaataaatatatacgtgaacagatgggtgtgactcaacgctagcaagggccttctcagaaagtcatgagctggatgccctcatgacttcagctgggtgctgaagaaaggattctctagctcagccagggggcattgaaccagaccatctttaaggacctcacatggctaagattctatgactggaagatgcaaaagattcctctgggatgggaccttccagtaggaaacttacccattaaagggcataaagccacagccaagaagccaggaagacagagtcaagaagatagggaagtttgaaagacatttctaagaagttctaggacaagtaatgcatgatagaaagaagggctggcagtgagtgagattcaattggatcaagattgcagatgactaggaggaaaagttaaaagctaactcatgggatattaaataagacaccaaacaaaaagaatagattagcccaggtgctcctaagcaataatattatatcactggtggaaagaagaagaaagtaacaatgccattatttgacaagctataacaagcataagaagtgatataggataggaagaaataaattttaaaaacaccaacacaaggacaggaagcacagaacatgtttggcccagttacaaaggagaggcggcaaccctcttaacacctatttggggtcatttgtggcatgctgaggtgggccatctgcttaaagacatctttgtcaggtccctgtgggggtgagcaaaatgtctcagattcaaaactaggttgatttcactaccagcctgattttgctcagctgaccagtttgctacttttcttcttgtatcaactgcatcttcccctagtccctcattctcctaactaggcaagtatctcttatttactaagtcatcaatttcatcacctctttggtcaactacctggtgggtgactccatatggataactatttgagtagatctgagaataatatatgcatgtatacctgagtgaaattcagttttgtgtctttacatgttattatggggacatatgagtatacttgcctgcagaaacctgtatgaatggctcattccatgtactaaggtctagctatatctgtgttagggttggaaaaataaccggaaggatctagagtggctgtgtgtgtgtgtgtgtgtgtgtacgcgtgcacatatatatgagcacgcacatacacatgtggtatgtctagttctaaaactatgttgtaacggctacaggaatctttgcccccttctgttctctaaggaaaccatctactcttctttcttttcctttctttgcttccagctaatgctggctcttccctggcagtgaagtgagcaactagcatctatgtggggataatttttaagtcagtgaaacgagggctcactaatcactcttggaccagtggatatcccacacgtcagagatggacaaattagcaaattagagaaatatagattaaaacattccaggaagaatttgaactttcctccagtaagtgaaattgaccatatatagagtgaaactaatcatacacaaactgaaatttatgagcagtgtatctcttccctggcttagtgaaatagtagtatgtcagtggtaagtatattagatttctaaatctcttagtattagtaaaataggttaggtcttttaagctgtgatatatgattttgatcttgacagttcccactctttaataatgagtaatgggagaagtaaatgaacaagtcaatggcaaaaaggagagtctctcagaaaaaacaaagaaaaagtagggaaggagaggtgaattcaaaaggcaggtgccaaagagtgaatcatccctgtggggtctgcactttttattaggctaggagactagatatttagttgcccaagaagttgagggatttaattttatggtcctttgaggttatgtttttagatacttaggcccttcacatattatcatctatcttcacaatagatagcttcattcccgtttacagatggggaaagcaaagctcagagaatgtaagtgactaacccaacatcacatatctagtaagtaactaaagctcataattgcctagctcttgttttttttccttacgtcatgatacctccatgtcttacttattcttaaacaaacacaaaaactatacaaaatacccttcttcttggcttctgctttttttgttctaacattgctagacctcttgatagaagactctatacaaagtttattcttgctgcattgatttcattactacctcctttccgctcaacctcctataaatggttaatatttctaaggttttctcatttccaaatgtctctaccattcccttggcacttagcatatgacacatcaaattgttaattgttgtattatatcagtagcctgaatccacaataatcaatagctctggcaatgcccatgtcttagatctttctgtagccttcagacaccttgagaacagagttcttaataaatcactagagtccaggaattgacaaagcatcagtgaagttggggtaatgatcatgttagtttcatatttaggaacaacattggtgtttgtttccattttaaaagtaagataacctggccttcatgaagttcttccttgaccacctggacacaaacttatttaatgacttatccagtgtttggaaatcatgaaaaagctgaaatcaattctgatcagaaacaattgtgaccgagctacagagaacatgcccacatacatatacaccagaaagaacaacattcacaatcccaaaggtaagagaaccaggagctatctatatacacatgcacagtcctacttccccaaaatgtttgactggttgaggagaataatttaattgcagtgcttcttcccagcctttgcaccttccctacatgcccaatgtgcttctgaggttaagatttaactactcaccatcgcctttggggtcgcttagagcagtgggaggaatgactgatgagcgatggcttctgaagcaacattccttggaaaaccgtctcctacagtcatcatgcacctgaaacgacaagagaagagcagagaaaaaaaaggagggggagagaaaaggatatcattgatcagtcttgagttccaataccaagatttagattcttagtatttaatctccctttctgagatttggtgccatacatatatccctaactcacctgaacacccccattctactctgagcctacactgtctctcagtgtggcctcagaactctggtcctttcaaaggtagctttcagaagatacccacctacaggcactgagaaatcaccagttctaaggcacaaccttagtggcctgcagaatggggaacttacatgcagtataaaagagttaataataataatctaatattacacttcaatccttataacaacaggtgtgtgaggtagaaaaaacactattgaattcattttaaaaatgaagatgccaaagctcagagaggtaaagggttttgcccaaggtcaaacagctgggaagtgacagctgagactctgctgcctttcccacaagcggccattctttccagatttctgacatcttcaagtgccacttcctggaaaattacacattttctagggggaatgaacctggcctggttattcaaaagcaattgaaaaaaaaaaacagaggacaaccagagtcttctaagaagaagcccatacttcagtttcttcttgtctagaaaactcagttttggagaagcatctaaaaggctagaaatctagatcagggtctctcaacttcagcattactgatattttgagccagatagttctttgttatgagaggctgacctgtgcattgtaggaggttcagcagaataccaggcctctacccactccatgtcagtagcgcttccctccaccctgagttgcaaaaataaaaaatgtctccacacactgacaaatgtctcctggggggctaaattacccccagttgaggaccactggtttagaggcatggtagtgttgtagttaagagtgtggtcggctgggaacggtggcttatgctcataagtccagcactttgggaggccaaggtaggaggatcacttgagcccaggagtttgagaccagcctgggcaacatagcaagactccgtctctacaaaaaaattaaaaaattagctgggcatggtggcatgtgcctgtagtcccggctactctgaggaggctgaggtgagaggagcccacctcacacgagcccaggagtttgaggctgcagtgagctgtgattgtgccactgtactccagcctgggcggcatagtgagaccctgtctcaaaaacaaaaaacaaaacaaaacaaaaaagagcatagtctttgcagaattatgtatgaatcaagactcttgcttactggctgaatgaccttggacaaatgaaattggtccaaatgaccttggaccccttcacttttctgaccctcaccttcctcatctgtaaaatgggaacaatgaggcccggtttaggcttattggaaggaataaatgagatcatgtatattaagcactcagtatatagtggcaataataatgtgttaatattatcaaccatttttaattaataaaggttacaagttcctaggaaatagtgaatgagaaagggagtaggtttctcaaaggcagactcagaacttatttttaattgcccatactgccattagagagctcagcttttcccatttgttagtaggcctcaccaattaagaagcaacaaagatggtcttaaatctttctcccaaagaaaggctccatagtcagatctggaaaggcaggatactaagatttatactatggaatctgtttaacctgttttgagataagagtttcttagatttctatctatgtgtatacatggtcaagctctaagccactccctcgccaggagttaagttctctaaatatcaagatgagaagagtcttaccgtagaattacaccacaggcagcggaagtcttgaagtctttgataactgccacagctctcatgacacactgcacactgagagctgacaggcatgtttccttctacccattgatggggcatgttctgcagaagggtaaaaagacacaggaggtagaagttagagacataaggagaggaagggccaactggaataattgtactactccatggaggacattaggtaaatgacccaaatgaccctgccctccctactccaatgcaagtgaacaatgacaagtggaggagggaggttcattcttccagataagttggattgtgagcctaggactttgcttatctggagttaggaagaagtcttcctccccctgtgtatcctggttgaaggggacatgggagaggccgactgtgggaagacatggctagtacttactacttcatctgcaggcagaaggaggtcatcagtgatagacaatgtattccacttgcagtctttgcttgctctcaaagcacacaatctgtgagatttcactttgcacactgtgagaagaggaagagaaaagatgggtgtgaatctggtgacagtgaggattctaattctcttcccaaagctgctctgaaagttagaacacagatgcattctaaatagttctaatgcacctccaaaaacctatttccaataggatccagttcctttttattcttactggctaatctttttattatccaacttgaatgaaaattgatggtaagaatgaggtgatttctgtctttttaacacttgtgataatatagtcccatccccccacactcatccttctattttcatcccctttatgttagtttcctccctttttctttcctcaatcagggttaacctcacaccagagtcagtgacctagtatgagttaatgatactaaagccacatgagttccttcatccctatatctacccactgagcttcacttcctaaaggaatcagaaaggtaccttcacagatgatggcatctctagataaggcaggaatgctctctcgacaaacattgcagtgctgggtccggtggctgtaactggagtaccaacaatgcattccaacaagaaaagggttgttttctgctgcaggtatctaaaataaataaacgagaagagagaatggaggatgaatcacagagacggattaaagagggcctgaaaatctgctgctaagtctaaaatggcctgctgtataggtgtcagagcgtgtgaaggggaagactgaaagttggagccaatacctgggacctgggatactttgtgtgcgtttttgtttgttttgccagtcgtttcaaaaagaaaaataatagaggggcagaccctggaatagaagctgaaggcaggagtaattatctttttttttttttttttttgagaggaagtcttgatctgtcaccaggctggagtgcagtgtcgcaatctcggctcactgcaacctccgcctcccggattcaagtgattctcctgcctcagcctcccaagtagctgggactacaggcatgcaccaccacgcccggctaatttttgtatttttagtagagacggggtcaagtgatctgcctgcctcggcctcctgaagtgctgggattacaagcgtgagccactgtgcccggccaggagtaatgatctttatactgcttggccaatcactctattgtcttagttcaagcaaaaatgtgttgtcttagccttggccttggttctctagccagggaataaagacaggaggtaaggctctgactctgggctagggaatattataataaggctttaactacctcctggaggtatacactttccttcctggctgccaggtgagcagagcattgctttacctggacgacagtttcatctcaggggattcttttaggaatcccttgagtattcttttaggaataccacgctctgactgcctacagcagtttcctgattaatcagcttaattcatccaataatccattaaacaaatatttactgagtaaatactttgtgcttggcacttttcaaagcatttgagatatagtgaacaagacacaacccctgcctacatggagtggcattctttttggtgtcctctttcatggtactgagtttgacattttttgttaatgtgccttaacattttttgttaaatgctgcatttgtatttcacagcctgactttcatgactgtagggaaagcaagggtataccagcaacagttttgagattgaaagaagggaagggtgagcaccaaaaaaactccaaggactcttacaccttttcactaattcctgagaatgtctgattttctccttctctgccttcccctgaagttcagacataggcgtacacagagcttttcattcttgacattataatgagttgggtgtgtaaaggcatgacaagactttaaaaagaactatattttctttctgacatcagttgacagtggggggagagagagagagagagagagagagagagagctagctactgagggctctagcacattaagtattcatccttgatcaatttacatgaattagatatccaagacatagcctgcacattgccctctctgaccactccttcccacttctggcatgctggttacgtgctaagctactgttgatttaacctggaaccttctggaagggaaagctattttgatgaactaaaggctcacatgttctgggattgctttgtgattgtaatgtttattgtacattaagacactggaaagctctagggtgattagaatagaagatggagagtcctgagggagtgacatactcttggctttggcactttgagctcctagaacctttctactccccaagtcactagattgtaattctacaagcatcttttttttccctcccagtctcctctcctccaataattactaagaacctattatgtatcatctaccatggtaggcactggagatgcagagatgaataaaccatagttgtttccctcaaggaatttatagtctactggaggaaacaaattctaaaacagatcattcctgtatagagtgacaagtgaagctcttctagaatgtgcaaggtttcacaggactgcgtggaagaaattcagagctctgcctgggtataatattaaatttcatcatctaaattgcctacagaatacaaaggaataggtaaaatggacattacttaggttcagcagttgaggtgatggaatttatattccttgtgtacatcctattctgtaagaaaaagttgatgcttcccaccctggatgagtatgtgtggcgattgaactgtgtcccctcagaaatatgttcaagtcctaacccttggtacctatgaatgtgaccttacttggaaataggggtttaaccgatataatcaaattaagatgaggccataatggattagaacgggccctaatccaatgactggtatccttataagaagagaggaatttggacacagacaggcacacacaaagaggagaacaccttgtaaagatacagagcacacagacacaggggagaacaccaggtgacaatgaaggtggagattggaatgatgcatctgcaagccaaaaaatgccaaagtttgcctgcaatcaccagaagctaggaggaggcaaagaaagatccttccctagggtcatcagagaaagcatggctctgcagataccttaatttgggacttctagactctaaaactgtgagacagcaagttgctgttggttttaagccatccagtttgtagttattttattatggcagccctaggaaactaatacagattttggtactgggaaatggggtgctgctgtaacaaatacctaaaaatgtggaagtggctttggaactgggtaatgggtagactagaagaattttgagacacatgctagaaaaagcctagattgccttgaactgagtgtttctaaaaatatgaacattaaaggtgtttctgatgaggcctcatgtgaatatgtggaacatattggaaactaaaggaaaggtaatacttttataaggtagcagagaacatggctgattttgctctactgttgggtggaaagtagactttgtgagcaataaacttgaatatttgactgaggagatttccaagcaaagtataagaggtgcatcttggtttctctttgctgtttatagtaatatgtgatagggaagtgatacactgaggaaagaaattgtgttagtctgctcaggcatcataaaaaatagcatagactgagtggtttaaaaacagaaatctaattttctcacagtttacagctggaaagtccaagatcaaggtatcaatcaattcagtccttggtgagggcttccttcctagcttgtagaaggccaccttctcactgtgtactcttgtggtttttcctcaacgtgtgcatgcagagagagagagagagaagaaagaaagagagagagagagagaacacctctttcttttcctcttattataaggccactaatcctatcagattaggtccccaccctatggccacatttaaccttatttgcctcctaaatgtcctatctccaaagtcacattaggggttagggcatccacatattaatttgggtggagggcacacaatgcagtccataacagaactattaagcaaaaagtcaccagaactagaagatttagaaaattctcagcctatccatattgcaaaacccaagaaagtgtgccctgcagagaacatcaagggtgtgtctggacaaacttttgctggagagattagatgtgggacacctggctccgattaaccacttcagcagaacactgtcagattggactgaacttggacttaagggtacagatatgggataaaatgaaggaaggttgtcagacttctgagattctataggcatgaaacacactgataaagcgactcagctgtgaacatgtgttatccttcaagaaaatggaagaatgacttccaggggtagctcagaggccagcaaggctgccgagagaggctcagaggccagagatgctgctgttgccatcataggcccaaagaatgtgggcccaaggggcagaggcactgcctccttggttccagagggtggagttgtctcctgggttccagaaggtggggctgtctccttggttgtgcaggggcttgtggggggattgactctccagtgagctaagagagtagggttagagaacagaacacctagccccagagaattattctcaggcctggagaacctgatggaatttgccctgctgggttgccaatttttttttaaacccacaaccattttattccttccattttatccctttctttctttttttgagacggagtctcgcaccgtggcccaggctggagtgcagtggcgcgatctcggctcactgcaagctccgcctcccgggttcacgccattctcctgcctcagcctccctagtagctgggactacaggcgcccgccaccacgcccggctaatttttttttttgtatttttagtagagacggggtttcaccgtgttagccaggatggtctcgatctcctgacctcgtgatccgcccgcctcggcctcccaaagtgctgggattacaggcatgagccaccgcgcccggccattttatccctttcaaaatgggaatatctgtcctatgcctgtctcaacattgtattttggaagcatatagcttgttttcttggtttcacacgtccatagatggagaggaatattgctgaggatggaccatacacagagtctcattcatacctgatttagattatttacaaaatgatattttggacttagatttaacgctggaatgtgctatggcttttgaagaggttgagatgacagtgaatgtattttgcacattggaaggacatgaatttgggggggactagagggtggactcttgtggattgaattgtatccccctaaaggatatgttcaagtcctaacgtccactacctgtgactgtgattctatatggaagtagggtctttgaagacatattacatttaagatgagatcatactatattatggtgggcctcaatccaatgactgctatctttataaaaagagaaatttgaacataggtacatacagagaggagaacaccatgtgaagatacagagggaacagacacaggggagaatactatgtgatgatgaaggcagagattggagtgatgtgtcagcaaactaaggaacacgaagaattaccagcaaccaccagaagctaggaagaagccaaaaaaaaaaaaaaatcctcccctaaatcttacagagagatcatggccctgttgacatgttgatttcagacttctagcctccaggactctgagaaaataaatttctgttgctttcagccacaaaatttgcagtaatttgttacagcagccttaggaaactagtacagtatatcattacaggtcttcttacttgttgacacagattaaaaatccattctgaagacagatttaaaactgtggcatgtacacaaaccacggatctctaaatgctaaagaaagtagttttctttaaagctttcagtgtgtggttgttgggtttttgtgtttgatttttactctctgtaaaatacttaggtgaatacattcatgcagtccattgctccgatcggattcttcatttgcaatggactgaatgcttgtgtacccccttcatatcatatgttgaaatcctaaccctctaggtgatggtattaggagatggggcctttgggaggtgattaggtcatgagattggaatcctcatgaatcgaattagtgcccttataaaagagaccccagagacccatctcagtcccttttccaccatatgaagacacaagaagacaattgtctatgaaccaggaagtgggtcttcaccagacactgagtctgccagtggcttgatcttggactctctggcttccggaagtgtgagaaataatgtttgccgttttaagccacctagtctgtggaattttttatagcagcccaaactgactaagacaggaattggtactgagaagtgaggagtactgctataacaaatacttaaaaatgtagaaaaaactttgaaactgggtaatgggtagagattagaagagttttgaggtacatgccaagaaagcctagattgttctgaatagaattttaaaggagattttggtgagagctcagaaagggaaaaggagagctgtagagaaagcttctatcttcttagagtatacctgagcaatcatgaacagaattttggtagaaatgtggaccggccaagaacatgttactggacaataaagaaaaagtgattgttgttataaagtggcaaagaacttgcctgaattgtgtttgtattctagtgtttgatggaaagtagaacttgtgaatgatgaaattcgatatttagctgaggatatttggttcctcctgactgcttatagtaaaatgtaagatagagagtgacatcaacaagatggtggaataggagttctccagcttcactccctgcactacagaaatccaactggcaactatccacaggcaagaataccattatgaatatcccagaactttggagtgaggctgagacaacccccttggaccacagaactgagaaaacccagggtcaaatggtaagagtaatggttctctttgactatgccgcttccccctcaagctggtgcagtgcctcagagaatttccctggagttatggtttctaagtgggaaaagagagttgaaggcagatattcaacttcctcacatttcgggacccttcaaaggaagtccactcctgtcttgtcccacgggaaacattggtagtaccagcagggctaggtcacttggggtcagtaagaaacaaaaaatggggtggggctcacagtaatcaatgtatagatcttggtggctgctctgtgttcctgccaatggaagtgccacatcagaggagcttgccaatagcaccatgctgcaggaaacatggtccacgggtcttccaggcttgaatccctagctagcttcttcagacaacctgggtgctctgattaactcttccccaggccaagggataactgttaggccagcgattacccatggaggaacagctggccccatccaaccctagtgtcagagaggtgatccaataaattctgatgctcattgacaacaaagccagacaaggacacaacaaaaaaagaaaactacaggctaatatccctgacaaacacagatgcaaaaatcctcaataaaatattagcaaactgaatttaagaatacataaaaagaatcatttaccatgatcaagtgggatttatccctgagataaaaagatgatgcaacatacataaatcaataagtgtgattcaccatatcaacaaacgaagaattcaaatcacatgataatctcagtgatgcagaaaaagcatttgacaaaattcaagaccctttcatgatttaaaaaagaaaaaaacctctcaacagattaggtatagagggaatgtaaccagcataataaaggccacataacaaactgatagctagtatcattctaaatagtaaaatgttgaaagcttttcctctaaaatcagggacaaggatgcccactctcatcacttcttttcaaattctgataattgtcatatgtaaaaaccagagcaattaggcaggagaaataaataaaagatatcctaatagaaaagaaacaagtgaaattgcctctagttgctgatgacatgaccttatatatttaaaaaaacctaaagactctaccaaaaaactgttagaactgataaacaaattcagtaaagttgcaggatataaaatcaacatacaaaaatcagtagcattttatatacaggttgagtatctcttatccaaaatgcctgggaccaaaaagtgtttcagatttcagattttttaggattttgaggtatttgcattatgctttcttgttgagcatcccaaatccaaaaatctgacatctgaaatgccccaatgagcatttcttttaagcatcatcttggtgctaaaaaagttttggattttggagcaattcgggtttgggattttgaaatttgcgatgctcaacttgtaccaataatgaactatgtgaaaaggaaattaagaaaacaatcccacttacaatagcaacaaaaaagaaaatacttaggcgtaaatttaaccaaggaagtaaaagacctgcatactgaaaactatagaagatcaattaaaaaatggaagaaaacacaaataaatggaaagatatgctgtgttcatggattggaagaattaattttgtaaaaaatattcataccacccaaagcaatctacagattcaatgcaatccctatcaaaattccaatgtcattttttgaacacctttcctctaagatcatccagtgtcatttttcacacaaatggaaaaaaatccttaaatttgtgtggaaccacaaaagaccctgaatagctaaaacaatcttcaccaaaagaacaaagctggaagcatcacacttgctgatttcaaaacataggtaaagtgattataattaaaacagcatggtactggcataaaaacagacacactgacaaatgaaacagggtaggaaacccagaaataaacccatgcatttacagttaactgacaaaagttgactgacagcttttgacaaagtttccaaaaacacaaaatagagaaaggacagtcttttcaataaatgatgttggctggatatccacatacaggagaacaaaattagacccttatatgaggggtcctgaacctctgagccatagattggtaccagtccatggcctattaggaaccaggccgcacaataggaagtgaccagtggacaagtgagcattactgcctgagctctacctcctgtcagatgagcagtggcattagattctcataggagtgagaatcctattgtgaactgcacacatgagggctctaggttgcacactccttatgagaatctaactaatgcctgatgatctgaggtggaacagtttcatcccgaagcccccctaccaacccccaaccacagtccatggaaaaattgtcttccatggaaactaatccctggtgccaaaaagtttgaagactgctgccttataccgtattaaaaaatcaattcaaagtgggttaaagacttaactgtaaaagctgaaactctagaactactgtgataacacaagggaaaaagctccccaacattggtctgggcaaggatgttttggctctgacccccaaagcacaggcaacaaatgcaaaactggacaaatgagattacatcaaactaaaaatcttctatacagcaaaggaaataattaacaaagtgaaaagacaacccacagagtggaagaaaatatttgcaaaccatacatctgataagaggataatatccaaaatatataaggaactgtaacaactcaatagcaagaaaacagcccaattaaaaatggcaagagacctgaacagatatttctcaaaagaagatatacaaatggccaatatgtacatgaaaaaatgctcaatatcattaatcattaaggaagtgcaaattaaaaccacattgagataccacaccacacctgttagaatggctttttaacaaaaaagatgaaagataataagtgttggagaggatgtggagaatagggaactcttaggcactgttggtaggaatgtaaattaatatagccattatggaaaatggtataggggttcctcaaaaaacctaaaaatagaacaaccatatgattcagtagttccatttctaggtatatgtgaaaagaaactgaaatcattctgtcaaagggatatttgcactcccaagttcatcgcagcattattcacaatagtcaagctatggaaacagcttaagtgtccatcaacaaatgaatgattaaataaaatgtggtatatatacacaatggaatgctattcagcattaaagaagcggggaattctatcactggtgacaacatgggtgaatctggaggacattatgctaagtgaaataagctagcacagaaaaacaaatactgcatgatctcatttatatatggaatctgataaagttgaactcaaagaagtagagaatagaatggtggttgagggagaggaggagggaatggggatatcaaagggtacaaagtttcagatagacaagaggaatgaattttgagatctattgtgcagcagggtaactatagtcaataacaatgaattatatagagtatttttaaataattaagagagtaaatttcaaatatctcaccataaaaaatgataggtaatcggggtgatggatatgttaattagcttgatttaatcatgccacctcgtatacatatgtgaaaacatcacattttactccataaatctgtgtaattatgatttgtcaatcaaaattaataatttaaaaaatgaaacataaataaatagctcattaatcagttttattttgattatagttaaaattataatattgtacatatatttggttaataaaatgttattaaaatgaaaaaatgtgagaggagataaatgaattgaggatgaaattgttaagcaaaaatcccatagaatttagagattttggaaaattctcagtctgtccacattacaaaaaataagaaaatatgtttgaaaaggtgtgaaagacccactatttgataaggagattagtgtggatgtcaatcacagacttaattagctatctctacaaaagccagcaatagagatgggattatagtagcagaaccactgtcagctgagactaaaggaaattgagaaaatgggatgaaacaaagaagaccctacaggactggaccatagaactattcggatgtgaagttcttcaagacaagtaaagaatgatcccaaaggtgattcagagatcaatagagctgccatcccaccacaggcccaaagtgcacagttctaggtgacaaggctgtctccacgtcaatttcaaagggtggaaaccaatgcccagcagagctgtggggatggaagagtccagcagagccctggggacttgcttctgttctaacagagaatcatgccatgaatagggccactgtagagagccacagcattggcactgccctgctgatctgtgggggtgatgttgccactcgtgtaggtctggaaggcagagcattgagccagaggattacagatgctcccagtttactatggggttacatcctgataaacccagtaagttcgaaatattgttaagtaaaaaatggacgttttgtagacatgatgggatgtaaaaacacaaagtacaatatctcccaaaactttggcaacacagtgcactgtagaatatgggttgtttaccctcaagattgagtggctcactgggaactgtggcttgctgctgctgcccagcacggtactgcctatgactacctcaggaaaagatcaaaattcaaaattttgaagtactgtttctactaaatgtgtattgcttttgcaccattgtaaagtcaaaaagctgtgagtccaccatcgtaagttggagaccatctgtattctccaaacttaagatctcatggagcttgccttgccaggttttcgacttgcctgggacctgtcatttcttccttgttttctatttctcccttttagaatgagaatgtctatcccatgcctagttcaccatttctattttggaaggacataacttgtttgacttcataggttcacagctggaaataaattttgtccaaggctgtctcacccatatctgatgtaaatgatatttagatgatactttagactttataattcatgttggaatgagttaagacttttggaatttttaggtgaaatgaatgtattttacatgtgagaaggccattaatttggaggtgtgcaggggcagatggcaatgcactgaatgcatgctccccacacgttataggaagtgatggatccctcatgaatgagattagcactcttataaaagggaccccagagagttttcttgctcctttttctgccatatgaggatacaatcagaagactcccatctatgaaccaagaagcagcccctcaccagacactgaacctgccagtaccttgatcttggactctacagcctccagaagtgtcagaaaaacatgtttgttgcttaagccacctagtctatggtatttttattatggcagcctgaactaagacatcactgatgtagggcagctaagggtactttctccacctcctgaattcctttcagcataatcgagaagtcatatatgtgtattaattatttgtctagtagttaaatgaaagcttattgactccaaagcactttccaaatgtgaggatttagtaatattaagtgtttgcaaagtacataaaagtatcaggtgaaatatcccacaaagcacaaagttggctacagatataattccataaaggagcctttttggggatggcttacatgataaaatgttgagtttagataaaacgaagtcagtggtttgtgctttaatgtgaactaaactgctcagttctatcaaggtttggggaattacagaagagtgttagggcctcccaggttggccattggtaggatgaccatgttgtccaaattgggccactttctacagtgaaaggggagctgttaatacttatgccgggacaagtgtaaactgggctcagcctgagcaaaccactagccatggacacactatgcatgagttagagtcattttgccactttgaatttatttgttgatctatacgattcagttgtctaccttagtattcctgccccataatcacaaagggtggaaattaaaggacagaaagaagataattaggaggaatttacgatatcctcctgagaacttagattaaaaatgaaaagaactaagatattaattttgccagaatcaacttatgattttaggtaaggcaactgaacctctctgaggctcagttttctcatctgctaagtgaaatcttggaatcataagcttttcaagttgaaaggaattttgaagttcatctagtttgcccacttgaaaaaaatcaattttctgtacaacatctgacaagcagttgttcaatttgtttgtttgtattacttccaatgatagggagttgtccacctcaagagccagctgatgtcattcctgcaggttacagtgaatgttggaaagttatttcaactagaccaaagtttcagaaaaaaatttccaagatttagagctttaggaacattagatggacttttttgcaagaaacttagttctctacctttggaagagttcaaataaaggccacatgacttacatctccagatgctctaaaatctagtatctggagtccagataacttttaaggtctatttctgtttccacggtcaatgattccatggcaattcattaggaagagctaactttttaatctagtcttccaaggagctccttatttctaactttctccttttattctttctttaaatcccccaggctcacacctttcatctgtctgtgacttttctatttcatttgcctctttcttatatttaggttctcccccacccctaactcagtatccacacttgtcctccctttctatcctcattctggggcttaacacggtcttgccataattaatcatagcctcttctctgaacttctggcctctagtttttcccttgtctaacccatcctgtatttctaaagtatccctcttatcaattctcttcccttttgaatccatcctgaggctttactttgaacacattgcaaatcttccccactctttatcctggcattgaaaaatctccatggtcaggccccatctacctctcaagacatacttcttggactcactttcctaaacttttctggtgaaatgaattctccctttcactgtattccaaaaagtttctgttttcctgttattcagcttttgcttataccagttccatagcccaggacctcccactgcccctaattccctgccaccaataaaatacaatctatctttcaaggtcagtctcaaatctctcctctgttaactcttcccagaggactccagcccatacttatctctttctcctctgaactcccataccactttattgtctgtttcattcatctggcaatcaatcatgcattgccttgtaacatctctgaaaactgtcatttatcttgggtactgtcatttaactgtttcttttgtttctgtgtatatagcgtctccctattacctacaaagctcattgaggcctggagcaagtattgcatcttttttttctactctttatgaaacagaattgggcaactagtaggggatggcttattaatgtgtactgactagtttccaatagattatccaattactttgtcaccactttaatagaccactaaatccatgattaatcttcccttgccctatttgtcaggcattggtggtgacagaagatagaagggaccattagagataaggcacatatgggagaaagcatattttactatttaagcttcaagtaagacaaattgctaagatgctggtgccgagacgtttcactatcagctaaaagtgttccttaatagatttaggtccctggagaagctccacagaagttgtgattacaacctgatacaactcttccaagagagtaaacagggagatttttttcctttctagtttgtgctgggtaatcaatacctaggtgtttaattcaatgaattcagggatggcgcaccaattctctggtagtcaccagaatttctctaggagtttttgcattcctagaacaataattaaaattcaaaacatcctatgcgaccttttatgccaaattgaaaatgttatatgattcatgagaaaccctccagtttgaatagaggttaagtcataggaaggaaagatattggtccacagggacaaagacaggaaaggagcatggaattcacaactttttatgactgcctctaatgttgtaccatagtggcctcattgattggggcgggggcaaaaaggggatgtgcttctccattaggaaaggaagaagaaagtaacaaagaggtaaaattctgagtgctaaatcatataaagatcaccatcaaatgctaagccaaggatctctcaatttaagcatatataacatgggactgagagaggccttaatgatattggagagacctcaagtcagccatcttgtcatgttccccatcattgctatagggaggagaatgtatagttatgagactaagtggtcaaaagcctgagaagtcctcggggagtagggatggatggttcttctctatggcattagttttatttctaaactgcattatcaccaagccacttcacacactgctccatccaaattgcctagaacaatcttctacccattgctagttatttaagacattaggttgttttaaagtctggattcaccttcccctttatctctaagacctttacagcagaactttgcttcaagatgaaccatgtatcattctctgtccaaattctggttccaagatttcctgcagattcatttattcattcaaaagatatttattgtgcctttactatgtgccagagaccgctgtaagtaaataagtgacacagatctctctcctcttggaacttacataaattctaactgtggtagatctatagaagggcaggcagagtgtatctcctgaagtttgattgcaccagttactgcagggagcagtggccagagatttggtaccaccaggtaaaaaagaaccctgctaagctttggagaggatacttattgctcttccctctacattacttttgtagtagacagaaaacagaaaggcaaagagcacagtggtcaaggacataggctttggagtcacatagcctgcatcagaatcctggtttcactactgaatagtgattctgccttggactcgttcctacctctttctgagtctcagtttccttagctatcactatagtcattcagcagacccaagtcaagactgctgattccggttttcctaacctaagggcatctacattagctgctcacatacatcttgagtgactcatccattgggcatacattgacatctacatatcaagtggatatgtatagaagtatctgcaccacatactcacaaaggtctgagtccaagtgaattactcctatttatgaataattctaaagaggttttctgtctataattcctaaacaggtggtctctgcttccatcttattatttccctgctctaaaggtggcttaactaatgcaattaattatttacctattaagaattgtgtggcttctctactagttttcttaccttataaatttctccctgttggatggtttttatgatgttaatccattcttccatgtctttccggttgggtgcagccagagtgatttttcgttgtggtgtaataacctaaacaaaaagccacattattagctggttcccactccataactttgccttcaaacacagtctgtgaactctctaagaaactacacagatgtaccaagcacaacataagccacttcttgaatataagacagacattcccagaaccactcgtagctccttagttacccatccgaaataataataatgctaatagcaataattaacattttaatgccactcactatgtgccaagaactattctaaagcactttatgcatatgatttcattcaatcttcattacaaccctgtgagatgggcattgttatttttcccatttcatagccgagaaaaccaagacaaaaagagttaaatgatttgctcagggtcacccagcaggtaaaaaactaaaccagaattgaaatccagattctttggcttcagaattcattcttttaaatactaaaccatgtaccatctattactcaagttagtttgcctgaaaaccctacttgcttactgctactctgtctacttgaagtggtaaaattgtatgtggttcattagggtgtccctgtttctgtttagtgggagagtgagatgtctaaaaacccagtttctttctttcttatggttagggacaacctgaagagaattttacagttgtctttcttaaccctgcttggcacaagaacccaggcaggaataataagaatgccacactgagagtctagcagatgtagaccatgggcaggacttgatcttttcccagagggcaggagggatcatggatagctacagcatcagtcattgcttccattgccctacttgcctttactataagctccccaagtcttgaagctagagctcaccacaccaacaaggaatttgtttcttcttttgcatgtaacacagtgagattatgtggtcgatggaaataggagctagttgggattgtgataacagccactcctttggtccaaacccattcttgagtggggctgatgttcagtgcttctgtgctttaattaagttaaggggcagcctagcctttatgatttctttctttgtagaatggaaaccaaaaacattaccctataggctcatcacccaaagactcagctttttgggactggtcaacagagccctcagttttaccctgtgtcagggtgatgtaatgagagagtaacaaagcaaaatcttcttcttagacccagccgctctcctttcaagggaggatggaacatgaaccaactatggaagcaggatattgggtctgcagctctttagtctgttaggtactatcccctacatgcctaagcaggaactccagtctccatatcccaccactgaggctgggagaagacaattctggaaggaggtgggtaggagaattcctgggccaccaagctttctatttttcagtgagttttctggtctggattcacttgaatgaccaaagccatgtgacatttcagtcacacaaagccctagacacttccctagaaaatcttctgctttctttgaggcactttcatcagtaatctcaacatggggtagatttcactttgaattagggctcttatctacctcatcagaggagaggatgtcatgtaactcaattatcctgccattttctataacatattagcagtctcttgaaagactcccagtgatactcttctaaatcaccttcactgggaggactgatttttataagtcacatactcccttccccttgaaatcagcttagctttatactggtaataaggaacaagaccatcactttttttcttccctatcagtgggctgctagaaaatgtttgcatgaatgataacactttgggatcaaaggaaactttggaaacctgaagttcaaagaagcaagaagtggtcatggaaagctatcttcccagctagcccctacccctgcccattcagtcattcccaatcttacttacacaaaaactgtggcaaaggtttctacagctgctttctgccacagtggcttgagacagatcaatcgtttcaaagtgtgcaaactggaaagatataagacagagagggacaaggaaccgtctggttaatgatgcaaagagacattaaaaggtaaacacacacacacacacacacacacacacacacacacacttactgacaggcatttgtggcagtcatgatccaatcatttctttggcttgagggctaaaatttatttagcaacatgatttttgttaatgtatcatgtgaccaaaaaatgaaatcaaaataaactttttacagacatttatgtggaattataggaaggcttgagttggtcagctcagaattatttaaacataaaggcttatgctggaaaagataatgagatgtggtctaactagagtcctagagaaacagattgtgataaactcctattttattgggtggcaacctttgcagtgttgctagtcccatccagtttgaggcctgtgcctccttattcactggccatagtagataccatctagccagcagcaggaaatcagtatcatggatacaggcaaggccggtttcaccagtatacaaactgtgcagtcacacagggccccatgttcagaagggcctcacacttagtttaatgctttgttgttgtcatcttaaaattacctcataattttgtctttgagcatgtgttttgtaagtaaagtccaatgggacaacagatcatgcatatgagcagaggagataggcgcattatacatttccaccccatgtcttgttgctccatttgcatttgtgatgcccgtgaacatagaattctagtggacccatgataagtgggagtttagcaagactcaaatcaagtacaagataagtgtgttacatctataactgagtaagcagtaggggagctgacagccctgagaggtcatactttctgttggaaccagaacttgcttcagacataggaaaaagacaatggtttctaagaaatacaaagaaccaagaagccctattgtattctttcttgctcgttacacccctgtgttagccaacaatttctgctaaaaatgatgacatggaaggaaatggaaagataaggcaacccatagttctttcagttaaaaaagtgttggtggaatgtgcaagtatcgagaagtaaaatatgaacagttgagctagttttgtgcagtttttttatactactgagaacaaaatactacgcttgtatgagctactaaacacaaattgtataattttagtgattctttatttgaattaaatgctcttacatttgcatttaaaactggtgttgtatagtgtgcagataaatagtgaaattcatgctaattatttaaaatcgtatttttctttacttagaattgcattagcaaataaaaacaccatgacaagtctttgctttatattaatattttagtataaacataaagcgttatatgttagtagctttaatacaacttccccctgctttttgaataaagggcactacattttcattttgcactggatccccaaaattatagttggttctgggtgcagaagctagctgggaaaaatacaaaaggaaagggatacagaaaagagaaaggagagaaaagtatccccatttgacccaaaagggcaagttaaaaaaagagtagagggcttcaacttccaccctaatgtttgctgacatgtctttacttattagtccatcttcccacacaaaggtttcctggcacccacccattaatctagttgacaatatgctatacattaccgcgggatggtgtgcaaagtagagcttctgtccttgaaccagaaaatatctaagcttccatctcttgaaagagttacagttcttcagcataggtccttccttcaatattttctgaaagatagaagcatggtgttgagcaattagatcaattcataaggtcatatcacttgttttctcagatggaaacagcagatatctagaaggctctatcttgtcacatatctgagaaatggcctgaaggccaggtgagaacacagtgaagctcattcaatcagatgagacattggttacccttggattactcattcaggatgatataggtttcacgtttatcagactatgtggcccaaaaaccacagaggatatctctatttgcagtagagggcagggacatgaacatcataaatataagaacagcattcttaggaaagaatgcgtggtagaggaaaaggctgtaaaggcagattttctggaagtctccagattgtagctccagacagggctctcctgtcagctcttttagagtgttccttttagaatattaagttagatcatgttccttccttgttcgcaagcctccaatagcttctcaacacgtttagagccaaatccagtctttaccatggtttgtcttcagcggactcatgatctcatgaaggagcaagcacataaaaaggaaccacaagaaaactaccttctgattactttctttacatctcatagtctaaccactgatttttcagttacctgctgaacagactgatcctaaccaagcatagagtctacttaccattttcatcattgaggaagttctcacttaagttataggatacaaaccaacatgcaagactgccatttgggagaagtactcaaccccaacaagctggaatcaaatccatacttaatggacaaagggccagactgagtttaaaatcaccacatcaaggctctaccatgaattctatcatctaaattagcattcaccattgggtggctggagaagtattttgtttggcctacctagtgtttttcaaagtttcaaattagttggtaatatttgaaaggtggaagacttcatataaaaattcaggtttcctgtttctttttttttaaaaaaaattagaacatctggtaacattgcatttatattctcacatggcaacaatctgcagaaactgagtaccagctgctcccttcagatggggtgcctgactccagcaggaatttgagtttaggactctgatctaaacagttatttgccattcctgttctcccaaatacacacacacacacatacacacacacacacacacgtactcatacacacacatttatacactcttcaattctctaaccaattggatagtactagtagacagagcctctgtatctcaactgaaaagtcagttcataagcagtcacaatttacctgagccctcttcatagcttatgggagtttcaaggttattgtaacacccttgggatgcaaaagaatggtgctgaggagtcagaacaaagagaacaataagatcttgtgggaaggagggaggttgcagtgagagagagtaagaaattatatttaaattgttgaaattgagtcatccaagagaaaacaactgctataagcattaataatatattgttcctttcccctttctggccaggtggcctaaagtacagttctcaaaaatggcttttggtttttttatcctaaccttctcacctctatccatatacttctccatactaagtcttcataatacctaggcagtcctatttactcctttctgctaaagacttaatttccaaaatttaacggctccaattctgtacaactgaatcaacatccattatctctgcccttttcccaacttgttctgctctgttaaaattattaaatgcttcctttactcttcttattttgtcgtatgtaatgtcccctgtaccagctcattttacagtttttggttggctacttttcccttccctccattcacagtttaaagtgttgcaactctgactgtcagatatttacactactacattctcttggcctgttctgagaagcacttacccttaaagaacctatttttcaggcattgcaagtcatgggctagtaaacaaaaatctttcaatttataacttgtgaatatgatagcccaagaggactcagattttagcttatgcatttgataagctctttaatgatattactatgagcaagaaggagaaattattatctttgttcaagttcctattttatctgcctgtagatcacatccccttcctcagcaagtcatcctgtttggttattcagagcctactcccaacaaaccagtagccaccctcaactcaggggaccccaattaagctctaccactcagggggcccttacagacaatagagctatataggaataagttttctatatctccccataattaatacaaatctgaaatagattctgataagtaaagatgtataagcccagagcaacaactagaaaaataacttttaaaaattattaatacatcataaagcaacaattaaataccactacatgtggattagaatagctaaaacccaatacagtgacaatactaaatgctggcaagaatatggagcaacaggaactctccttcattgctagtaggaatgcaaaatggtacaactagtttggaagacagtttggcggtttcttacaaaatcaaacatacttctaccacatgatctaaaaattgaaatctttgctatttacccaaatgcattaaaaagttatgtccacacaaaaacctgcatatgaatgtttatagcagttttattcataattgccaaaacttggaaacaaccaagatgtccttcaataggtgagtgggtaaacagactgtggtacatccagacaatggaatgttatccagtaataaaaataaatgcactataaagccacggaaagacatggaggaactttaaatgtatattgctaagtaaaagaagtcaatctgaaaaggctacattaactatatcaatacaactacatgatattctggaaaaggcaagactatagggacagtaaaaaaacacagtggctgccagaagctcaagggcagttgggaagagatgaataggtggagcacaggagatttttagggcagtgatactaccctgtatgatactgtaatggtggctacatgtcattatacatttgtcaaaactcatagaatgtacaacaccaagaatgaaccctgatgtaaatgatggattttagttaataataaaaaatcaatattggctcaccagttgtaacaaatgcactgcactaatgcaagacgttaataataataataataataataataataataatgattgtctcaggaccttggtcagtttagtagccccaagcaggtaacaggggaaactgggagggggtgggagggggtatatgggtacattctttactttccaatttttctatatatctaaaactgccaaaaatggtctattaattttttttaataagcaagcaaaaacaggctgggaattctgaaaaagaagaataattaagagggaactacctgctatttaggttttaaaacctagtataaagctataataatgaaaaaaataattaaagggactaaaatgttaaaattgttaaaggaacataaacatatacccatgtgatatggcaggggcataagtatgtggaatattcattgaaaaatacaacaaaagctctgtctgcaccctggctgtttgagggagtggttgtttgagttctttaagggaaaaagagatggcagaaatgaagtaatctgttttatacctgataccccaggtctgagggtatgagaaggggagagtttcaatgtgtgtctaccagtggagatgaggaagatttatttctgaagtggatgatgagattgtggagctactttccaataataaattattattattattattattattaacacattttagattaagtctagaattactctcgcagatactatggcttgtcaacacaaagtttataatcctttggcaccagaacagggttggtagcttgtgggaactgtccttcttttgcctatcaagttactttgtttctgtcaaaagccaaattaccatctggaaactggaaacaggaggacacagtcaaccatgacaagaacagaatgtcaaggctagggagcaagtaagctctgtggttctaaaattgtttagtgagataaacctcttcaccaagttaaaagacccaagagggcattgttggaaggaaccaaatgaagttgtattgctttgaataagataaaatgaagttaaaacctactttttgttaattaagttagaatgcagatcttcttaggggataggcaagggctctcccttcaatgcctcctttcgcagggtgcatgataagagttccttaagttctaaacagaggctttgtgtcatcagctctgaacttccacaaatgcccaaacctggatcttggaaaaggtaaagtacctgtagtccttttccttctgaattctgtcctcctttggggaaacttccctactcacccaattactgtttctaaataaaccattgtttattttgtcaaaaccccaaaaccaataggcagccccaggaagccagtttgaacaggcagaagctaaaaatccattgcttgattgccccaagtcgataaactatgtgcatgtaaaacaatctttacccgcttggggctactaaactgaacaaggtcctgaggcaaaaattggaagaagcaaggtaacaagcaaatgcatcctgccaagggaggcactgaagggagaacccttgcctatcccctaagaagatttgcatactgcttcctggtccctggcctctggcagataatatcatctcattgcctcctcacaactatgcagtatcacgtctgacttccagacagtaaatctgaggcttggtttcccttactttgtccaagtacccacagttacaaaatgctagtggactctgtgcttcctctccccgtgatgagaaaactgggagggcctggttttttagtatgtacacaacaggttgaacacagaccccaccccatccccctgccaaactttattctgaatgacaagatcatagattgctaagaattaaaatgtattctcggcccggcgagcacgcctgtaatcccagcactttgggaggccgaggcgggcggatcacgaggtcaggagatcgagaccatcctggctaacacggtgaaaccccgtctctactaaaaatacaaaaaaaaaattagccgggcgtggtggcgggcgcctgtagtcccagctacttgggaggctgaggcaggagactggcgtgaacccgggaggcggagcttgcagtgagccgagatcgcgccactgcactccagcctggaagacagcgcaagactccgtcacacacacaaaaaagtattctatgaacagctctgactattccatactagaactcttaatgagcttccctcaaagtggcaaatgatattccttgtttttctaaagacctaacattcgttggcgggcgagaagggagttctccagtttttttaaagtgacagtccaagattgactggaagagtaattagaattcacatgttgacagcactttgtaattaataaagtgcttttgcttctcatcagccctctgaagcaggtagtgaaaggcgttttctaacgcaattctgtcctatgaaagacaccctgaaattagcatcttcaagtggcttgcccgaggaaatagttgaaatttttcctctcaaataagatagcccatgtttgttttgcagttttgagactttgcaacatcttggagttaaaacatttgtcagaagaacgcatctctgatgttagtacaaaaggcaatgaggaatgggactccatatgggaaattttgcttggtggccacatttataagcacacagctatttcataagaagggacacacatgtagtcctcctggtccaagctgccacatttctgtggcaatatctgtgatgctgcagatagaaataatttaggaagggctgtagaatccttgtacatattgaaatgtcatgttaccactcgacgcttcttaaaccacagcacactgcaggcagggttcctaattcttcctgccagctctattagacattaaaacccaaataacattatggtttctactattaaaccctcaaggctgattgttttgtggtgagagtgagtatggtgctaattagtctattgtcccgaattcaatcaccacagagatcaattggcttcattcaaattcaagaatgtaggactccaaggcatacgtaattcaggtcctgtgtacagtgttcacacaaaatggtctttgccaaaaccatggcagcccttgcagagaaggctaaagctttggaaaactctgcttcagtttcattctgaatcctctttgataaaccaatacccaaatccattgctcccagaaactcccacaccctggcacaggtagtatctctctctggtgctctgtacaactcagcatgtgtaaattaataaattaatgaggataaacatttccctcaatccatatttataaaatatcttctataaaatatttcaacagagtctgtaaagcagcccaatttcctgtatataattaacacccccctgctgcttaattgggaaagggcaagtacagctgctgctgtgaccttttcctatgcttctcccaagtccctaaagcttctactatctgctacatctgtttttctgttgcttggtgcatttttttttaagagacagggtcttgttctgtcacccaggctgaagtgcagtggcgcaatcatgactcactgtaacctcaaactcctgtctcaagtaatccccttgcttcagtctcctgagtagtcaagactacaggtgcccgccaccatgcctgactaattttttcatctttttgtaaagacagtctcgctatgttgcccaggctggtcttgaactcctgggctcaagcaatcctcccacctctgtaatcccattacagaaatgagctaccatgttcagcctgcttggttcgtttttgatgcataaggctttggggaattatttaccttttcctagcaaaagggtcccctgttataagccaagttgaattccacccccacccactcaaaaagtagacaagcatcatgacatgcaccactacctgttattagttggctgctcttccgttttaatttctcttgttgctcttgtgtaggaggctggatcaagttgggggatgagtaagctatcattcccaggtgagaactgaattattacgggcacaactgagaaggccagctttctgtctatgactccttcagtccaaagacctggaacatctattgtctttgcttgggttagagtgctgggaagaaagctgtttcctaacactcgcttgccaaagttgattcaaagcaactgtgtttgatttggttaaaatgcaactccgggtgctttaggctttaagaaaggtcagacccactgctccactgaaagctttacattccccagggtcctgttgacatggcaggagtcagacagactggctccagcacttactagctgtgtgaccttgggcaaatcacttaacctctctgagcctcaatttccttgtctgttagatgagaataccttacagagcatgtgcctgccactctgtgagtcccttgtcacttgtggattgtggagccaagggctgctgccatcgctctgctcatgccactactggaatcttccctcctggctgtctaagggctgcagcagcaggatgaggaataggatgaccaactgtcctggttttcccaggagtttcagcactacaatcaggagggtcttgggcaaactgagacctcgtggtcatcctaacactgaaaagccagatctttctaccacgcaggtctgcaaggactgtatctgcaaatctcctcccactgcttcctgtgctaaggaagagctatagatgaacgtctgtgtccctgttctctatcagtgaaataaaagaaagttgataatgatgctatacgtatttatttttatgaataggcaaaaactttaaccagttccttgcatatcactaaaaaggtattttacacacgtgagcaaacatatatacacatatattcttttttcttcctgtaaatcgtagcattctatgtacaatgttttgtttcttgctttctacacttaatatacaatgaacccttttagatgttgatacatattaagtggtttcctttctttttacaattgcatagcattctactaaatgaatgtaatgtgatttatttaaacaattccctattgaaagacagtgctttcaaatcttattttattacaaatgacactgcaaaaactctgtatatacatgtcattttgcactggtctgagtacattgataaaataaatatcaagagttgatgactttaaaactagtccgctgggaccataaagcctaaacacctataagttttgggggagccaaaaacatagaaacaggaaacccagtgaaaggaacaatgtaaagggaagcttagcctttaagcctgtgtcttctcaaatatctctgcccctccccccttcttcttttctattactggaattcctagggagggtaaggatcactaattgtttggggtatggggaggaggtgagcaatctgagcccaggctgacaaagttctgaaagtggtaacctggcccttggtaattgacctgggactagctgcatccaggaaggaggaagagctctgctgagcccgcccagaactacttataggtttgaatgctggctttgctgcctactagctgtgcagccttgaacaagccatttcactgcgacaaggggcctactgttaagttggtaggatggagatacaagctctggtctatgttagttcaaagtctgtgttcatgccacaaaactggccttttaactttctgagctaaccgtgaccttagtaatgagtaatcttagatctccctgccctgttagagattatgaaaataatgctccaagaggggctgtgcttactcaagtcaaatagcaaattagttgtagagcactgggcctcaggccaccgtatttcagttgtgttgggactcctcaccaacctccgtaaggtgagtgaaggtgccctataactgcagccattgagatttcactgtattgggaatgcctcttggaatatgtgcacagttacagggctctaggggaatggcatggaatggcatgtgaggaaaccagcaggaaaatggcttgactctaagagtaggatcaaaaggaagggctgggtaagagctttgggggtttgaggagaaaagtggcttatgataaaccttcctgcagaaggttgcctttgctccacaaatccagggaagactcaaagttctgagtaggggaaagaggattgtttctgaccattggagagccaaaagccaagaaacaggaaatccagtgaaaggaatagtataagtggaagcttcatgggagacacctatggctacagcagtagttgctgcttgcctagaaaagaagcgttttggtcacacaaagttcctccaaaaagataccagggtaacttggaccctggtcctcaacctaagcaagatcacagaggtcaggacatcagttagcttatctggtgctgccatcgcataaaaagtgacaaagcaatgcctgcttccaattgccttcttttccattcttttacctgaccataagctaccagagaagaaggttctgctaacattccgtggacgtttattctctcagggacacttccctcactgcttctaactaaccctgggctcccaccaccaagaaacatgccctgtttatcctaaccatctactatgagagctgtggctcctgttgtgactctggcgatggccctcattagaagcagcaggagtagcaatttcttctctaagtttctcttcaaccctccttctccaaaggaagagatttgtttctggctggcaaatgcctgctatttgcccttgctttacatgcattatcttatttaatgcccgcagccacagtcctgtgagggaagtgaagaagttggggctcagagaggttaagtgtctagttctaagtcgcagtgaatagcagagctggggtttgaaccctgatcttttttactttactgtctctccccaccccactctcatatcaaataactacatgatgacggttatcatgatctgacttgggtgtgagatctaacttggggatcacttcagttcacttcttttttcccccaggggccactatttcacccagcaggaaaagccatggaccagtgatatctgcagatttcccactagtttagctgaatttcttgaaggggaccatgtactgcaaatgatttcacaagaaggcagggaaaaaaaaaaacagtcctttagagaggtacctgaaatgtcataatcctgaattttgcatatatacaactttgtaacaatatgctggaccatgcttgggagcttctaaatctggagacttcagcccccagaggtatttaaaagtgcttgcaacctaaagccaaaaaggaagcttgtaaatatgcaaatacagttatgcctcacttaaagacagagatatattctgagaaacatgtcattaggccatttcatcattgtgctaacaagagagtatgcttacacaaacctagatacctagatggtattgcctactacacacctaggctatatggcataaactattgctcttaggctacaaacctgcacaacctattactgtaatgtaggcagttgtaacacaatggtatttgtgtatgtaaacatagaaaaggtacagtaaatatacaatattataatcttatgggaccaccatagtatatgaggtccatcatcgactgagacattgttatgcagcgcatgcctgtatgtaacttatttggctacaactcactcaaacagcaaaacagagaaactcaattttggtgatttctgtgctctggtttttaaaagtacccatttctttccattcatggctttaaatgcctcttagaagtggggatggtgagcccacatcacctaaacacgtatacttgggaagtacatgtttactcctgagctggggaaattgttttattgccaaactggacccatgcagacagacatctgaaggcctgaataatacttaagaatacattcactaaaaagtcctctggggaataagtggttagattataaagaggggatgtgtgggtttggtttttactttttctcagttttatgaagtggcattaccaagaatcatgaggaaggtagacagaaattgatgctagaccagttggttctgtttgcttcttgcagcagtggtggtctagggaagatgaaattcactaattcattaggagttgtgtatgagtggtgggaaaaggagtgtgtgtgtgtatgtgtgtgtgtgtatgagagagagagagagagagatattcagaaagagagagagagactcagagagagagagagagaatgcctctgtaccaccagtggtaggtgagagcaggaggaaagtgtcaggtaaggtcacctcaggggttggattggcttgggagtagaatgggtgatgacagattgatgggagccctcactcaattcctaaagctgtgggtagccttgctgcctctgagcagaggattgtccctggctgaacacaattgcctcacatggagtcaggagatatggtagtttgacagtctatcacacttggagggaaaagagagggaagagaagtgactgcatgagacactagtctgtcaaagaagaaactatgttgtgggccttggttccacagaaattactggccaggtaacaaagctgaaaagctgtaccaatgtgaatgtattcttggtaacaggaggctatcagggacaagcctcctggagaaataatagtgaaatgaagtgctaacagttggtgagtcctgactatgtgggaaggactatgctaatcatgttacattggttatctcatttgattttagcaactctgaaagatagacgccatgctaatctgagtcttggagagatgaagtagtttccctaatgcgttaataaatgacagagctaaaatctctcttgaggtttcacaaggacatgaataactagttatcccttcagtggaaggaaaaaaggaaggtttaaaccactggtcttattggaaattatatcctattctaagtcaatcgacagaagaaggcagatttggcaggagtttggtggtatgaatcacagcttgttggttcagttttgtttttgtttttaattttaaatgctaaagtaattaaagtaataattatttaatttacacagcactttgttggttataaagatattgaagattctcacttgattctgaacacaaccctgaggggtaggccaggtaagtaatgctattggcctttttttttttcaggtaataataccgtgactcaaaaaagtgacttgcccaaggtcattaagtagtaaacttgttctggccttctgacttccagtacaaggctcttttcactgttatcgccacactttatatgttctgtgttgtttgatatcattttgattagtagtccatatttcaaagcctagttttacctttcctgttatcctgcaataaaactctctgccatcatcactggtaaagaagtatgacataatcaagtgtgccagtggcaggcattctcttggttaacgaaagtaatatgacgctggacccaaagggaaattgtcctctgacctggatagctcctagtaataaaaaaattaacgtggccatacaattacgcacaaaagcatcacacaaggatcttactgagaaagactgagagtgcggctctcagtattgcctcccctcccagggagcaacttcccacagcttgttcagatgttttaccctagaacctactgctacctttttcacagtgtttcacctccatttatttccctgttgaaacaccatccagatctgcatccttttccaacttctccctgcaggcaaaaacaccatccagatctgcatccttttccgacttctccctgcaggcaaaaacaccatccagatctgcatccttttccaacttctccctgcaggcaaacacctggtaaaattacactcctctctagccaggctatgtataagggattaaggttgctgaatcctaaatggccactaactacagtaatcaaattctaacacctaccagccagggcttagagcaaggctgactgttaccatctggattttgtgctgctcaactcttgatagcatatccagaagggctgaccataaaagtacaaatgcaataagagagaaagagagaggggtgggagggaaggaagagatcagtggtattataactcagtctgataggcctggaaagggaggaggaagaggagtaggaaataaataagaataggatgagcatgttgcattggagggctagaggtggcagcaaacactcatagacttgtagatgacaagggatgcttattttcccatcaatgacacatgggattcccactggtcctggaaagatctctgagccaccatttcattgactctgagattgtgccctaatccatatgtgctgctccctgtttaaaatttctgggaagaggcagtagtggctactgggaagagaagggttatcagctgcaatctgggggacagccagtcttgaatcacacacacacaaaaaaaaagcaaaacagtgggcaaatttgtcctgtgggggagaagaactgtcttttaattggaaacagggcctaaacaataaagcttaataaagggaaggagcaagggagatggcaggggagagtccagtttgaagcaaactcactaacagcaatgtacacacccaaaattgaaacacaaataccatgacacagctaccctcctcttgccccttccacccctccatgcatataattaaaaagcaatgttctaattagactggcatctgatatctacaccttttctgaaatattgtgctaggccctttgtatacattagtgctaacagtcacaacaatatgtgaggtagttattatcatcctcatattacagataagacactgaagctcagaatgttcaacagacttctccaagaccacacacagttacaaagagggatgactttgaactcaaatttgtctgattccaaagcctagacacatttctactcattatatcacacacactgccactctttcctggaaagtggggagtggtttgaggtgagagagggtgaatagtttgcaaaaccacgagacacctgaataataccacttcacagaaacatttgcacacaggtacaatatgggcaccaatatggcacctgggaaagacagtggacttaatggattctgaacttcatggagtttagccaccagcagtaacctgctgtgtgagcaaatcctatcacttctccaagctgccatctccttgctaggaactatggataaagatatgaaaatttggcacttgattcatcaagggaagccaaggcataacagaaaaaacaagctattaatatcgcttaggtctgttgccataaagtagcctcctacttaatttaacactgcggggatagaccctgggcccaggaatagagattatttcaaaactgagcaggccaggaaggcaaacctcagcataaaactctctgggtaaatcacaaatatgtgtcatagccaagttatatctgtcaggcacagtgcccaaagtgccacaacttacccataattagcacttgatggatatttataaagtgaaattgaattggggaaaacacatctggagaggacaatgaaaaaggtattctcaaatgttcctggattcatttttctatcaattggctcctaaaggccagtcactattggaagaaatacactgaggattcttatattaatatatccaagcacatatatttatgcaaaaccaatatagtacagcaaaaaggagtgtagatttggactcagataaatccgaatttgaaacacagcttcatcacttattaggtgtgtgtccttgggcaagtcatttaacttaaaaacctttgcaattttatctgtaaaaatacacataatggcattcaactctcagtagggatcaagataatgcattaaagtgcccagtataaggtagaaacgcaatacatatttcttatttctttctgtgaatatggtggctatatttttgacccctaaattagaacacaagtcttgtcaagtataagtgtatatgtggttgcaacagggtagtgggggctcaatttgatattagtgttttgccccaaatttggaagcataatttacatataaatagtccaagcccagaaggactttactaccagaggttagggtacttttgatttgtgtggattagtccatgcaagcacagactctttccttcccatgagtaacagatcaaagatcactgggaaaagaaacaaagactataaatagaaaatcaaatttatgtctgtgcaagaatttgtgcttactgtagacactcatagtgctaggactcatgaggtccccagagaaaaaaacagaacctattacatcagaagggcttctgatgataggtatgaagacttaaggtgtgttgaaagaaatgctctattgaagcctggaagagaaaccagtgttagaataaggggatgagaacagttagtattagtgaacccaagtgtttgtatctctttaaatttagcacattgacatttcgaatctaatgctctcgaatgtttattattaaaacatcgagccaatttttgaaggccccaaaaaagggctgagttgaaaatatcctcttctgttgtattccatcagccacagttatgggaaacgtagtttcaagagctgctataatctgccataactgaggcatcaccattcacctggtgtcaatgtattctagtcatagcataacgtaattctgggccaataacctaagaggaaagcaatagcttttagagtctaaccttgcaaaccccaaattagttacatgacataaaagtaaatatcacaaggccatttttccacgaaaccaacaatgacgagcagggttttatcataccaatgagtaacatctatgactttactggacaggacctggaagtctacaattatatactacgtaacagcttctgccatgcacttagcctaaaacaaaaatccaaccctttcttattctattatactttgtcattcatgtgctttgggctctcaaggaaagtctagatgtagagttatacagtgacaaatggcaaatgcatcttcttatttactgcatgcctttgggaagctaagagaattggagtgggtgtcacagtaaaaaaatccgtctctttgctcatggctatatgggatgactgtatagttaacttgtcccctccaaatggctgttcttacctttcctagaagttcctcctcttccatttacctttgatgcagaggcaggaaatgctaattctatttagttctcgattctgtcaggagcacttgaagatttgctataccaacaaatcttttggaaaaccaaaagaacttttaatgtggggaagtgagtatagagtaggtgggcatagcttatgctaataaactttctctgcttattatagagaaattagctataagggaacaacccatttgccttcaatcctcatggcttcctggtgagcagaacttccactttagtgttcctaacttgatgagctttttgacttctccaggtctttctcacctagagacatggtgaaactcttttccaggctcatgattcactgaactatttttacccaggagtagcaagttacataatgagaaataacagggaaacatgaactgaaaacctcataaactttaagtaaatatgaaaggggacagtctctcttacctcaaaatgtataaagtgcatacacacactatctcctcattcaaggactcagaggtgccttggaatccctgtggtcaatcgtggtttactaattgattcccatatatgaatgttctccaaatagcatgtttggaggtaagaggacattctaactgatggcctgaaactaaggtgggtacacgaatatttggatgagagaagatagttctggaatgagcgaatagtagaatcaaagagagaagcagtagttaaaggaaaagctgtcagtgaaggatttcaggaaggcaaaattccgtgtataaaaccttttactgtatggaaaaaaagcatcaagcacacgttttccatgatgcttaaaatgttttatacattctgcctgatttgtcctttcaacgtcccacaaaggtaattgaggaagtaagttatcattttcataactcattgcctcagtagatacacttagagagtgctttctcttccccaagtttaaaatgcagtaaaatgtcatattttcttaatagcatctatttctaagaatgtcaaagtatgttacagaccatattcattttgtattattgccatttatatggtttttaacagaatgtgtgtgtagctatatattagcttaagtataaaccttttaatacattgatataaataaataaaaatgatgtcatcttatgtcttcttcctgggccaaaatgctttcagggtctcattgatacacttcaacaatggatcttgagaaatttcatagataatattccttgtcctcttgttgagttctgtgttctaatgcaacctacagccccaaaagaggcttcttgaatcagaatgctcaattaatttcctcaaggtaaatctcacaaggccatttcttcacataacaaacaacctagagcaactaagagctaaaaaatatgtgaaatgcacattttcaagtctcataacaggcaccctgcttaagttgggtactttgcttgaatccaagatataatgccatctattttctgaatggaatatgaagtcactcaggtttatgtaactatatttaaatgaaagcataaaacacattccaaaagccaaatataaatgtgttttgattagtcatgccacaactgagaactgatgattacaaaattctaaacaaacaaacctattaaacttcttgattacagtttaacaatggggctgtaaaaccctgggctcagctgtgtcaaggtacccccttgacaaataagaagaagaaacaacactatttcaggacacggtcaccaaaaaacaaaatgtgtgaagctgctctttttgacctctctccgtctcaggatgatgagacagattatggggagtagatctgtgtgggttgtggcctcaactctaagtgggaccttgcagaggattcatgtatgtattacatttctattgttgagtaacaaattaccacaaacttagtggcttaaaaagtaaaccatttattatctcagtttctgtaggttagaggctcaggcacagcttagctgagtcctctgcttcaaggtgtcaccagactgtgatctagttatcttccagggctatgttctcatcaaaagcttggctgtggaaaggtatgctcccaatctcccttaggttgctggcagaattcaattccttatggttacaagattgaggtctcagttttttgctgcaggccatgcttagctcctacaggccacccacagttccttgctacatgggcttctccaacatggccacttacttcatggctgcttatttctacaaagccagtgaaagagagtctgactagctcgtctactagcaacacagagtttatatagatacatatagtaacattatcacaggagtaacatctcataacttttgtcatattctgttggttagaaacaagtcacagaaattcacagatcctgcctacattctaggggagggtattatacaaaggggtgaacaccaggaggcagggatcatttgaggtcactttggggcttgtttgccacaacacaccaacaattctaccctaggaaacttcaagtccagtggcataaatcctcccatttccactgtgacatccctatgccagagaactaacatcttttacaacagatgctgtacttttaaatatactgtactatacttgagcacaaaatgacacagatagaaccaaaatgtatttttaatacataaaacaaagaaattatgtcctacatataaagcaaaatatttagcatccaaaaaatgttattactggggtttaaaaaaacactattgctatttttaaaaataattatagactcacaggaaagaaatgtgcaaagaaatgcagagggaggttctgtgcacccttcacctagctcccccaatgttagcatcttgtataactatagtatgatagcaaaagcaagagaatgacattggtacaatccatagagcttatttagatttcacagttatacatgcactcattttgtgtgtgtgtgtgtgtgtgtgtgtgtgtgtgtagctctatgcaattttatcacatgtgtagccttgggtaactatcaccacaatcaagatactgaactgtaccgtaggcacaaaactctctcctgctatccttctatagccacatctactccttctgccccctcccatccctaatccctggcaaccacaaatctattctccttttctataatttgttaattcacaatgattacataaatgaaatcattcagtctgtaccctttcgaggttggctttttacactcagcataattccctttgggttcatcaaagttgtgttgctgagtagtattccatgataagaatgtgccatggtttttatagcctatgggtagtctccagtatttggctatcataaataaagctgctatgaatatttgtgtgtacatttctgcatgaaaataagttctcatttctctggaatatatgcccaagagtgtaattgctgggtcatatggtacatccatgtttaatgttaacaaaaaaactggcaaactatttttgaaagtgactgtatcattttacatttccaccagcaatttatttttttaacttttattttaggttcaggggtacatgtgcaggtttgttatataagtaagctcatttcacaggggtttgttgtacagactatttcgtcacccaggtattaagcccagtactcaacagttacttttttctgatcctctccctcctctcaccctccaccctcaagtacgccccaatgtttgttgttcccctctttttgtccatgagttctcatcatttagctcccacttataagtgagaacatgcagtatttggttttctgttcctgcattagtttgttaaggataatggtctccagctccatccatgttcctgcaaaaaacatgatctcattcttttgtatggctgcatagtattccatggtatgtatgtgctacattttctttatccaatctgtcattgatgggcatttaggttgattctatgtctttgctattgtgaatagtgctgcaatgaacattcacatgcatgtgtctttatggtagaatgatttatattcctttgggtatatactcagtaatgggattgctgggtcaaatggtagctctgttcttagctctttgaggaattgccacactgcttcccacaatggttgaagtaatttacactgccaccaaaaatgtataagtgttcccttttctccacaacctcaccaacatctgtaatttttttactttttaatagccattctgactgatgtgagatggtatctcgttgtggttttgatttgcatttctccaattattagcaatgttgagcatttttctcatatgcttgtaggttgcgtgtatgtcttttgaaaagtgtctgttcatatcctttgcccactttttttttttttttttttttgtaaatctgtttaagctccttgtagatgccggatattagacctttgtcagatgcatagtttgcaaatatttttcccattctgtaggttgtctgtttactctgttgatagtttcttttgttgtgaagaagctcttaagtttaattagatcccgtttgtcaaatcttgcttttgttgcaattgtgtttggcgtcttcatcatgaaatctttgccaagttgtatgtccagaatggtattgcctagtttgtcttccagggattttatagttttgggttttacattcaagtctttaatccatcttgagttaatttttgtatatggtgtaaggaaggggtccagtttcaatcttctgcatataactagccagttatcccagcatcacttatttaataggaagtcttttccctattgcttgtttttgtcagctttgtagaaaatcagatggttataggtgtgcaaccttattcctaggctctctattctgttccgttggtctatgtgtctgtttttgtacctgtactgtgctgttttggttactgtagccctttagtaaaatttgaagtcgagtaacgtgatgtctccagctttgttctttttacttaggattgccttggctattcgggctcctttttggctcaatatggatttttacatagttttttctagttctatgaataatgtcattggtactttgataggaacagtgttgaatctctaaatttctttgggcagtgtggtcattttaatgatattgattcttcccatccatgagcatgggatgtttttccatgtgtttgtgtcatctctgatttctttgacaagtgtgttgtaattgtccttgtaaaggtttttcacctccttggttagctgtattcttaggtattttattccttttatggcaatggtgaatggaattgcgttcctgatttggctcttggcttggctgttgttggtgtataggaatgctagtggtttttctagattgattttgtatcttgagagtttgctgaagttgtttatcagctgaaggagttttggggccaagactatggggttttctagatatagaatcatgttgtctgcaaacaggatggtctgacttcctctcttcctatttggatgtcctttatttctttctcttgcctgattgctctggccaggacttccagtactatgttgaataggagttccaccaacaatttataagtgatacagttcctctacatcctctgtagcatttggtgttgtcattacttttttattttggccattctaataggtgtatggtgacatctcattgtggtcttaatttgtatttctctaatggctaatgatgtggaacatctttgcattttttgcttatttgctattgtatatcttcttggatgaaatgtctctgtgtgccttttgtctcttttttaattagattttttgttttttaaatgttgagtttttagagttatttatagagtccagatacaagtcctttgttggatatgtgacttgaaaatattttctcctaatctgcaatttgtctttttatcctcttaagaagttcttttacagagtaaaagttgtaaattttgatgaggtataattgatcaattcttactgttctggctcatgcttttgatagcatattgttatatattgcctttggagaaacgttcttcatgaaattctttctgctgtctttcatgcttttggaggcttttacatttatgtgcatacatgtgtgtatatgtatatgtgcatgtgtacgtgcatgcatgtgtgcatgtgcatgtacgctgactggtctaactagaaaagcttgagcttattgctcatgcataaatgctaatgcatatgtactacgatggaattcatagaaccatagctcctagagctgaatataatactgtaaaagatattatctagtgagggtttatttaccatgcctgatgtgcatggggaggaaatagctcataaaattacaattcctcttcaaattatactgctccatttataaaaattaaatagggaagcatgactattgtgtgtgtatatatataatatatatatatttatatttatataaatctgtcttgatttatataaatgtcttgaaaagtatgtggtcatacataagtcaaaaatctaaaattcgttaatgtctacgagaagtagtatgtgtgtgtgtatgtatatatatatatatattatatatatatataatatatatatattatatatatatataatatatatatattatatatatatataatatatatatatatatattatatatatatttcacagaagttgagatccaaggccactgtacaacaaatgcatgacacacctacttaataaggaaccaacatgaatcaaaattcagtaaactggaactcactgcagagcactggttttaggtgtttcatacaaagacaatcagattctatgagcttacattgtcaaacactgactagttatcattatccgccaactctcaaaacccaacttggcttaaggtagggctagatttctgacactttcccttgggttgtaccaatatttaaccaatttctgttatttgcaggataatcctttgtgttcagggcagagtccaagtgacttgcttggatttccagtgagaaattctcttgggaaggagggggagcagtaactcagatcttctgtattcttttcggaaatctttcaggacataaatgttgcttttcaattattttttttaaaaaaggagcgacttaaaggtgacataaaaatagcaagtactgaacaaactacccccaccccagtcaacctccagataaatgtggtggacagtttatttgggacccttaagcaaaaacatctgtaaagatcctttgaccctttgttaaatgtaaaataaatggatctccagccacctggacaactcaaatgcaagagctatttgtgtggtatttctaaacatcgaaagagaaattaggcatctggcagaggttacatccattttttgggtgggaatacttttaaccttttattaaagctcctttctcttttttttttccatctcatacccagtacttccatcttgcaggctctggccccaataccatttcctggatcccaaatggctgatctgaaatagggctatttgatcttctgggagctccccagatagttctgatttatttatttattcattcattttttgtgatcagcccagtctgcttagggacatctgggggtgggaagtgctttctaaacaaattactctattaattatccgagaatgcccctcacaggacttgactaaaagacataatgctagactcctacacagaaacactaactcatactagtaggaagagaaacacacatacatcagcaggggcaaatccatatgagtgtgcataagtatacacacagccacaaatggactcaataatgcatggagggcgtgaggtagggagtggtgagcttcaaaatagattctcttgttcttccgagagtctgtaaagtctgcatagctatcaggagctcacaatgagcactggatgaccagtatcccttaatagtggtgactcagaagatcagatgcctactatgagtcacagttgaaggtgtcccaacagtgaaccaggttaagggcttctatctgctttctgacctagaactccccctgcaggatgccctaggaataatggtcttcattgccccagagggactgcaggaacctgtgaagcagggaggaatggggaagtgcctctgtattcaccctgataaaataattgccaggatattagaatgaattgagtggcatcttttcctgtggtgagtattggggccttttatcccagagcaggggcagggtaaagtagaagtcattgttgtcagcttacagcctcaacagcctgcccacactagcttgcacacatcagtttccttctttgttgagatcaccactacattgcaggaagatcaagctctggaatgacagttgtatgctaaaccacatggtgacaccccaaagcaagaaccatgtgccctttagggtggcagcccagggagtagtcagaggggagatagcggaagtaacagcatttgagatattacccatttggagcctcatctcctccctcactcctcctgtttttcccctccttaagtggaacctgggaaagatccacccaaaggtgatgaaatattcaaatacctcatcaatagccatcccacagaggaagtgtctgctgtagtagaagccttggttgaaacatctaagacaacgttcaatggtattgggactagaagacactgaggagagacaaggcggactaatttattgtttatttttcctccctctgcgcagagatagaagccacatgccagagaacagaaaccctaagctgcctctgaggaaataatgtaatgggtcatacaaagactctagtgatcagcctccctagagagaaaaggcaatgatgaagcacagtggcttcaagagctgagccggctcacaaccactcctgtgctactgtttacaccactagtaccacgaccttgctcagacacgcatggggtatagagggccccaatagcacctacgactgagttgaagctttcttgactgacttctccagctacagtactttaacttttcccacgaaagtccccctggcaactgagagtcaatccctcgaattgactttagcctagaaaggatgactaactgtatgtggcgttttttaaatattttctttcttctaaatcatagaaaatgtgtagattagccttctgcgagatggacttgagaaacaaggcacacattgttgtcctttatgctgaaatgtagtacaggtgagagtgatgactagtcatgtatacacatggctgcaaataattgtggtcactatcttccatgctctacacacaaaccctatccttgaggccagccttatccactactcacactagatatttttcatacttttgcaactaagattcatatttggctccatatgcaaaaagacattctgtttctgagagttcctgactagaacggtctgcacatacattctcatttgctggaagtccaaggccaagccatgctgtatttcagtgtgttccagaaagcttttcttcatcctctaggcttctgattacttgaccacatcatacactggctgtttagtttccaactgccatttataaaacacagagcaccaactcagatgagtggaactgtgatgggaacttggatgttgctgccctgccttttttatctggctgaccttgttccgttggtgggcttcaagtggcagctttccactgtatacagaacttgatcctgttgcaggatgacacataagctaggtttgcctcacacttcccagaaggtcagtgctgtctcttcacaaccatttataatcatttgtctgtcttctaaggtgtatgcttagcaaacacagccatttgaccacagcagtgtatacatgactatccctggcattcatgttatttttagactactgagtcaaagttcttcccagaggacaagaggcatgctctgccatgagcctcctctatgaaatctcaaggctacttgagaccatggattaaatacctaaatctgtcttcatttcacctagagatggagagttgactatagaagatatcatcaactgtgaggagccttaggatcttggagaccttgtcagggtagccaaacttgatatcagagctcaggtctcttaatagtagcagatgttgcaatgtcaatgcataaacagaatagccttgttccctccaattcgtcttatggatataaatccatgcatcagaaattgtgtctgccatgtttgttatgctgcaatctcaagttacaaggccatcctaggaaaatatagttgtcagtgttctcagattcagaacaactctaatcaagaggggtggcagggaggaaggcaacacaaaatagttttcttctctaagtgaaaaaataaaaaaatggggctttgaaatttaatggcacttctctagtcctctatgaatgggaaaaaaactctatgtagatattgaattaatgcctctatctacttgaaaaatctacctaggagagactccaagtgaaaagagcttctttcaggacttaagtttctccagcaatttcttcagcagttggaataaagttaatacaaaactttgtgaactctcatacattgatcatgaaaggtcaccattctttgctgaaggaagttcatcattttccagaatgatgaaagttcatcgtcatcctcaatgattgaaggcaggtcacccaagtgttactaatattcttgctagagacaagtgtaaatgaaattgatgccaattctatgcacactggaaattatatatttatatacaatttatatgtagaatatatatatgagatagtgattagtcagatattgttagctcagatgtcgggaaagattaaaataatcattgactgaaaactcaggaaatcctacaattactaatatcaatgaagtatctaccacttttctatgaaaaattatggcaacaggcaagaacttactatgaaaaaagtcagagaggtacatgctaagtactcagaaatacttgttgaattgaattgtggatctttctcttaacattcccctttaaccagaagagaaggaaacagcagtaattaaaggggatatatgactctgatgttaagatgcattgttaagatagccatccttgttgttctgactttttccttattctgcatagggcactcatccttttgaaaggaaaacggaccagaggtcatgagcaagtatagcatttgcttgaaacaaaatcagtgttctccacattgtaggggctaccatagttttaaagaatcagttaggcacaaggcactgaactaagaacttgatatgtcatttgatccttagaaaaaccttacaaggtgggaattattagactgatatcataaataaggaaaatgagacgcagaaaggtgagtgagggtctttgcccaaggtcacagagctaggaaatgacagagctgggattgcaacccaaatgcgtctgactctgaagcccgctatattgcactgcaactctctcatttaccctcacaccgtactttctgtaggtagaagcaaatcttaactccattttatagacaaggacattaaggcataggacagagaagtattattccaaagagtctaaaacatttcttctttcatataatctaggctccaaagcggggaagtgaagtaaagaaatcgccttcttcactaggcttctaccttagaaaaatctctacccagcaatcagtcttagtgacataatgctcaacaagaggcagtgtacaaaataatccaacttgctgtgacaacaccacattgtggcagagatggaagcacagcacagtcctgagatgcacttgttaaaaaacagtagtaagcaggcagaaatctgggctctaaccctgtccccatgctctttactgttttttagtgaatgaattccaccatgtattggtgtcacattcattttaaagctatgcaaagtgctttacagaattcataaggctttaaaatacctttgagcctagaattttaaagtgcttcccagatattctatggtgggaaatatgcttgtttgcaaatggataaataagaagtgagaggttaaaagatttatctcaaatcacaaaggcacagctaggaatagagtcagcctgttaaatctcaattctgggcccaaagcactagactggtgtgtttttaatctcttaggaattgtagaaccttttgagaattctgatctcaggaagtctcaaacagtttaaatgatgaatcatcattataagcattttaaaagttttaagccttttaaaaaatcaatcattacaaccaccttaaaatggtatctcatcttaagtctggatttgtttagccctaaagaaagtaattagtcctaaaaggcaggcaagtggcccccattatcccactttgtttagaggaacctagatcatttctaggctcaaagaggctgctttgaaaaccttgtattaattatcttgaggtggactaggaagtggttttgtagtctggagccttgggcctcagtcttgactctgatcttcagttaagtttcctttagctttggttttctcatctgcacaatgggaattaaatgaatatcgctaattacagaggattggggtgagaatacaaggacataggacatgggaaatgcatgtgtataaggcattagagtatgatacaaaaatcaaggggtagtttagaaagacaactacattttttggctataacatgcctgattgggaaggtctctgaaggctcattctgcaatattataagcctagagagaaagccaattagaagtagtattccttacatgcatgacaaggccttccaaaagtatgacaaacagacatatacaggaaacaaaactgagactgaaagattctcttgaataccaaagactgaatatagatgttccttcatgtagcaactggccctgtataaaatgcatgggggaattagctcccttctcagacatggacatctctgaaagccaatcaagatctgatgctctcatggcagagaaagatggtgcatagaaatgggcaatccagaggggaaacgaaagcattgcagaccctcggatggcacccacaaagaatccagccagcctgagaaaagggtgagttgcagagtggagagaaaatgagacattatcaacatcctatgctacctcctctgaccatttctttctccttactccactattcacttgttctcccccagttctctcacaccttcaggcttaaaaaaaaaaagaaagaaaaagaaaaaaacagttttcccatctctgttcctttgctcacaccgttttgcttgcctagaattcccttctcatcactcctctcagcacctccacccaaataagaaaaattctggaatgttcttttactcatcactgaacccaagtctaccccatcttgctaggccccaatcaattcttatctcctttaaatttgagtttctcttgtggctatattcattttctatttgagattacagttatttgtatacttggtcttatttcctttacttgactataatttccttccttcaggcaaattacagttattggcacagcgctcaacacagagtaggtgttaaatgaatgattttagattatcattgcctgaggtaagcaggccaccatcatctctcaccttgatttctgcaacagcccaagtaacctttctgcattctgtattgttcccttccaatctatcctttacactgtcacaatatatatcttaaaaacagtactttcattatgttactctcctactcaagaacattaattaatatcctgctatacataataaggtccaaatccctctgcctttctctcaaagctctttgatatcagctgaatagggttcttgctgcttccaggtatttgtgtatgttgcttgctccctagtagtggaatgctttctcctctccacagatctaaattcagttgatctcaagtccatcaggaagccttccctaacttgaatttggagctagattgtcagtaggactaatgcaagcctctctttttttgtgaggactgagaagcaacagctaagctctgatgttcctttggcagttcaagttttatctaaaatagttttctactaattacaagaaaagcctcctccatcctttatttgtcctcttttataattctacagcattattctctgtaccacttttcctgtaacaaaatcatatctttccttatattgttatgtacctgtctccaatgtacacgttttgtctttcaaatgagattgcagaatttgcatccattttgttctttccacaaactggggacctactaggtcttcagttcacactttcaaacaattactgatttattccctgattattctgtctggccttccctttgtttcctccactgtctgcagctgttttaaggagcttattattcagttgatacctaaaagatgatgttgacttggtaagaccagttttctttaagaaagtcctcactttccctcaacattttcagagcaaattttataatgctctgagtatattttagcttgctgtctttggagatcttttaatatctgtatctatctatgtctctatttatctgtctatcactgctttgttgttcatgttaattcagcagttattaagtataggtacttaatacttcacactatgtgtgaagaacattaaaatagaatttttacatacagaacaatatattctcattattttaataaaagagaagtattttcatactcctcctattaataactggataaatattaaccttcattactagtttccctaagcgcaatatattccaaggcttataaataagcagttgtgtaatgagagaaaagacacttgcattccatccaatggcaacacattaataatattcccctcctttcaaagccatttggaggattttcatcaacaaagagagaatagccaaaggaaaaatagaagttattgaaaaaattactcaggatcaaccctttaaaggaaaatgttccttaaaaaattacacattctttctctcctggtttgcttccaatacttcaacctctaattcagtatttttcccctccccttttccctaaacattatttgcccacatttgtctacactcccttattgtcataatataccaattttgtcaaagcaaggcacttaactgccatctgctagaaaattgccacaatgaatatatacatctatggtgtctacaatgtgaaaggtgtcccattagacatgacaccctcatatagtgcacaacctgtacaactttatgtggtcatcttgccctgcagctattctagaaagggtagaagttttccttctcatttaaaaggaaaagttgttccttctgattggaaacaaggtgcctgttggggtttcctgctctctgattggagacttcatattctcttccctgaccagaccatttcaaggtcagggtgctaatctgatcagaggcattggtgaaacaagttaaggcttttcctgtaattagtagaacgctattttagataaaacttggactgccaaaggaacatcagagcttagctgttgcttctcagtcctcacaaaaaagagagagccttggaatagtcctactgacacctagctccaaattcaagtgccaggtacaggagaaatttgacactaaggtaatgagtcaagagcttttcaattaaagtgaaaagcctaccagaaatagattaaattctgattaacagttaagattagtgaaaaggttaccaaatggtacttagttatttgtttcaacctgctctccatatagtacacttaaatgcaatagtctttagtgttattatgctgtatttagtgttattatgtagtattttaataaatgtgcattttggatttttttaagaactggggagataaatcatcattctcatttttattaaaattaactatgttcatgactgaagactagtaattcaagaccacacaatcaatatgggcctcctcctagtacatatggtgtgtctgtgtgagttagaaaaatctataatcctctgggaagatatgaggcagtcctgcttaccaccgcctactggtaatgcaaaggtttgcacagggtgctatgggaaccctaggttctgggtgtctagcccggaggggatagcagtgaaggcctgctggatgagactgctgagctgagttaatggcacatcactggctttatttaagagacataaaagctaagccacagaaagattaagcaatttaccccatattgcaccaccatctaaattggagtccaccaaagtgaggtgacttccaatctaagaagagtccaaactcttcaacttcttgctacaagttaccacggagcaaagatttttgtgagaaaattccatactgatatgcctcacagacacgaacattagcatattaaaatgcaggcacaccaaaataacccagtcttgcagcattttaggacagctcattaacacctataccacaatcctggcaacctttagttcttcattttatagttgctgcagcttgctacaggaagatgtattgcatcagctcaaacttccttggacaccaactttaagaggcctgagtcattcaaatcattacccaaagtccttcgaccatcaaaggcagcaaacaaaagtaccgctaattaataatgtaattagggtttattataactagcatacatttgttctaggtctgattcacccttgctttgaactggctttgtcctgtttttatctgtgcttaattgtactgttttatgtgcatttgattttgtaagatacttcgtatcttttctggatgcaggcagagtgtaaattctaaataaataataaacaacggattaaagttatgtagaattagctcttttatgtgcttcatgtacagtttatagtacactgaggccccttacaaattcaatgtggatggtacgtttatgcctattttataggacttggaacaattttgctgctttaaatgattacagaggcttacagttatatactagcttttaccacatatttttagttatatctacagtttatttggtgtagtgttctttgtcaggaacacaatccccaaaaataataaagagctataagcaaagacagtgtgcattatgacaacccactttatgagatagttttaacacattccaggttaggaggagggaagaaagaaacttgagagaacggccatgtttccgagaaagtatgatctaccttctggaatattacaggccaaaatttaaaccctgacttgtttctttctttctttttctttttctttttggtcccatgtgctcctgcatcaccagcctccttgctaaggagctagtaataaacagggagcgcaaacacactctcctcttagcctaaaataagcaattgggaagctaagttatttacaaacccattttagcatagaagaggagtgataaaatactgcatgttttatgttaagtgtctggctttcatttattatttcattgagaaaaacatgagattctactgctaaaaaggttttaaaaccactggactacctgacccccaaaggctctttccaggacattctatgggtctataatactgaagataaaaggcttcactggattttcatcatggtttcttatttccactatagaaaacactgaaatgaaataggaaaaaatgtcatagagaaagcagatgagacttttgtaaccatgtaatgtggataaaagagggcctgaaacagcaggaaaaggatactagataatatatttattttctcccgttttagcttttgtagtttaaattggaatttagcatacaaataaattgaaagctggatagtttttaattatatgccccatcagccaaccctccacttcagccatgttatactaatcaacagctcttcaatgattgcacaacattaatcaggtgatatacaaaattttgtcggttgcgtttatttatttatttttctgagtctacttgccagggaatctgttgtctttaaaatttcaataggacttgcctcatctactttattttttacaatctttcaatcagtaccctatgattccctggccctggcctcacctgcccaattcaagtataacttcacttctactgatacttttcactgtcactgcttaatttaataccagttttctctcctctctgggtttgagggggatatattgttcctacgttcctcaaacaacttcttcattttttcccctaaacttcttacatcaaagtgaatttgctatcaggcagtctctcatatctgcacctaatccatctctgaaaacttgttggatgatgaattttgaattgtaggaacctttgttccattatttaggttggaaaagcgataatgcattcccaccacatctaaaagtcccaatatttcttcaaatatggtaaaacactgttaaatgcccatgtaacaatcctccaaatatgtatcatattataaagcatttaaaacaccaagtacctaattattgaacacttaacagacaagcagatactttgtgagtaggtcacaataatgccctgctatacggagtacaaagtacttcccacacaaaaaaacaacctttcaagctgtttcaaaggtctacctttgtgtttcatcattttcatcattagaaaaaaagacagagaaattcaaaaagttcagtgccagtaaggaattgtggaaaggcaaagtaaggctttttcaggaatttctagaaagaggactcacaagtgcgaaggaatataataagaaagccatgaagagaaccactaatgggtactttgattccatgtgaaaccaaagtgaagctctcacatccaaaaaaacaaacaaaaaaaatgtcaccaagttaagtaaattcaagcagaggagatcataacaatgtcaaaattatcattttaattagtcttaacagtcaaagagagttaagtagtttgcactagaggtgaggtagggaagaaagggacagtaatatccgaattctgggtaagagaaaagttgttttactcaagctctgcaggagggaaattgtcacagtaagcattaattgaggttagtgagaagggtaccaacttgctaattttctgaaatcaagaatcttgttctgcagcttcatttactgtcctctttattgtttacacttagctgttttaataaagctacatcatattttcctctatagtgcacagtgatgtgaataaaccatgaaataatatgttaaatgtacataataaatgcaagtgacacttatcaagggaaaattaaaaaccaagtttattataaaatggaactgagaaactactcttagagttggggttcagaggacatcaccatgatgctggagctgacttcaggacagtgagggctcaactgacagagcccagagttcatgaaaactttctgggtttcaagtctctttactgacagccaaggagcttaacaatttttgctcagcaggtacctttcatttcctgcgtcaagctgcaaaatcccagaagagaaaaggtagagacatttgctgcaggagaaggtaaatgaatgaacatccaggatttagtcctacaagccatactttcattcccctctactcttggaggcagggaaaaggctcagtcctcagaactactgcctcttgtttcagaagaacactgcaaagctctggatgtgtgggtgggtggggagcattaagcatatctctcagtatcctacacgtgcttgagggaaacaaggggtaagaatccctgtcctcaggggccaatatttcctttacaggctctttaaagcaagaggcttaaacaataaatgcctataatgctttggaagatgaaaatctctgaagtgctactgaccaggctgaagattctgatcttactcaataatgcattacacttcccttttaaattactgattcagccttggttgggttgtatacagtttattaactctctcaagttttgatcacacttggttaatgaaagctggatgaattgaatattctatttccttataattgtggataatgtcctcatatattcttatttcccttctgggtatggcatacccagtttagcataatgctgtaacttcttgttaaagagacaaagccatcactaattttttttttttttggcatatagttaaaagtgactcagaaatttagattttttccctttgggaatttaacagtgggaagataaggttggttttgttctggatctccttctccaaggccaagtcacaaaagctaactggacaaataaaatctaagtgtccaaaaaagtgcagtaagtaaatgtgagatcaaactgcatttgtatatgggagcaactgcaacaattgtgtctacataaaatctatatacttactgcttcacacagcaaatatgcccctgaatggttgtgattcaagcatatgtttaacaatcagatcagacaggagtttgactagatgaactttaagctaaaatgaacaagtgtttcctaaatccaaggtagaataatgaacacgatctaataattaagcgtgtggggctgtgactggggcagggtgaagcccgagacacaattgtgcattccccaaagtcttactacagaagactataagcaaatattcagagaaaataaatgaaaaatatagcaaaatattaacagtgattatctctgagtggtggggtactagatgatttttatttactttttagaagctttcttgattttccacattctctgaaattagcatgcattcctttattttattacattgaattttagtttaagtagaggaatgctgagagaactgactattaatagtgaataccttggcaaagcatctggtaaaacaaataaccaccatctgcatatttgttttggtaattgagtctctcatttaccagttttgcttaaaggtagtctcatccatgtggttttgttcactgtagaatcctcagtggttagcacaatgttaaacacatagcacatagggagcaggtatcagtttacgttttaaagaaataaatgaattttaaaatttggaaaacattaattgagtctctctgcttataaatatgatttgcaaattttatggatttgtgaaaatcaagcccttttatcgccctgcaggaacagacatcaaagccagcacataatgaaacataatggaggatggatcacctccattactgagttggcgaagggtccttccctgttaggtaggggtgtctgactaattggtagttaatagcaagagtgtcactgcttttgagtttatcatcaactcttaattctctgtagtgttagatgggaacaatgacgcagcgaattcccaaatcatttgttcggtttggaaaagaggtatgatttttccccagaaggtttgcctcctaattctttttcttttggacagtgcctttcttgggagtgttgcctacctggatgatggggaaggtaaccagaaatagactggggcagcgggaagccagcctgggattaaaatgtatcatcctttagccttagtgctgaatgtaaagttcactggtgccatttgagagggatagtaccttttctttgtacaacacttcagatctgtggagcctgtgggagaagtgagtgctttttttttttttttttttttgaggctttttttctgtctttgctttttcttttaaaaaatctcaggaagaaagttcaatggtgttggagggattatagccaacttgccttagattaggaggatttcttcccttttcctcaaatattttttttctcctcttggatgtggagaggaataaagtccattgattttagtaaagttgaaggtatctcctcttacaatggaagatttttttctttaaaaatctccaggggaaaagattcattgcttttggtggaggtgggggagcatctctctttaggtctggaggatttccattaaaaaataggttttgtggagaggacctacaagggcaacttgttttaatgaagctggggagccctccctagtaggatttttctttctttccttttctttaaaagaaacagtttattgggaaaaattagaatgggagacatctctcctggaaagattttcttttcctttccttgcttttttttttttttttttttttttttttttttttaatgaaacagtgaaggctgaaagatacataaggtccctgggatagggtgagattgggtacatacccaccaccccccccacacgcacattccccaccttgaagaagcttgagaaagagattttgtgtgtgtgtggtttttttttccttattgtgggggatggagagggtagtcatcaggaataatacgcaatgtctgcagtaaggtgttggtgcattttcctggagagaatttctttctttgatcctttaaaaaataatccctttgttaattttcttcttcctctttcccacccctccttctctgccaccttcactctatcctacctagtccttttccccttcccttcacatttctccccccatcctccttcctctctccctctcctttcctccgtctcccctttctttttccctctcctcccttctctccccctctttctttttccctctccacctctcccctttgtctctctctctggctccctcccttcctctgtctctctccctcttttttcctctccctatctcagtctctccctacctgctcctaccttcctctcctctctacctgtccggctttccccctccctcccttctcccctcctccctctcttcctctctctgtttctctccctccttctcccttctcttccttctttctccctctctccttctcccctcctccctcccttcctctctctgtttctctctctccttctcccttctcttccttctttctccctctctccttctctttgtttcttttttgttttcagaaaaatattcaaggactttggtgagtttgggggcatcttcattccttaagaaaaatatttctctttaaaatatactgttcatgttcttcccttcccgccccccataattctaaatgtatttgcttgttttgagaaaaaaaggggctttgttgaggctgagaatacttttgtttaagaggactttcttggctttgtgtttctcccctacctatcttttctatttgttctcaaattacaaaaattctatattaagaataaatcttttggtaaattatataaatatattaaattatcacatgttccctgaaaatatgtacatctattatgcatcagttaaaaattaattaaaaataaataaataaaataaaaagaataaagtttttgagtgaatttgagtcaactcccattagaaggattttctttcattttttcttcttttaaaaaaatcggtttttttttttttggttgtgttttgacaggaaaattaatgggtctttgtgacattgaagtacttcttctctttaagaggattctgtttttgtttcattagtaatatcctcttcaccaacacatatacccttccattcttaattttattttaaatcttaaaaaaaattgtattttaagaataaggtttatgctctttagtcatggaggagtggtatttcttttgtccctccctcccgcaccccccgcgcccctgcttcttggaattaaaaattctggagatttggtatagtcagggacctatcctttaatatttctttctttttttaattaaaatgtgtgtatctagaggggaggattcgtaaatttcattaacttttatgatttttgagaatatctgcccttaaaaagatttcctttttttgtttgttttccttaatttctttttttttaattgaaggggtggcaaataaaggttattatccttggcgaggttgaagatcctttaagaggatctccctttcttttagttccttttttcaattttgtttgttttttgtttttgggagaataataggtctcttatcttgtggttagagggatggtatctttctttgaactatttttaaaaattgagatgtaatttacataccataaaattcatcatcttaacatacacaattttgtgggttttattgtatccacagtgttgtgcacccatcaccattctctgattttagaacattttaatcaccctcaaaagaaaccctgtactctttagccatcatccccttttccacctcccatattgcttccctcatttcctttccatctctaaggatttgcctcctctgcacattttatgtaatcgggaaaataatgtcaggaagctttgatgaggttgggggaccttccctttatttttgcccccttaattttctcaagagattaagcatgagccatgaagtcaaataaagtttacaaatttcatgaatattttaaggttagaaatactgtttaacttaagatgatttctcttttttcatcttaaaatttttctttgggggatataagttccatgggctttgatgagggtgaggataacttccttttagaagctgtttctttttttttcttaaaataattttcagaggagagataaatttcattatctggggtcactgtccctttcttttcgtttttaaaattcataaatttgtttttattattttgagaatgagctctatttgctttggtgagggtggggcatctccctttagaatggctgcttgcttgcttttttttttttcctttaaaattattttttttccactgaaagaattacagtgggtgggctttggaaaggtcgggcaccctatccttagcaggatttcaatttatttcctttacaaaacacacacgcaccaacaaaaaaggtctttgtgagtaatcggttcagggtctctgcctcttctcgtttcttctctggctcctcttctatgctggccccctctgggagcatcagaagtggagcagcaaccaccgctttggaaaaaaattcagagctgatgaaatgtcagctaaaagactgttcttagacaaatgaggatcctatgtatcacaaaaggccatatgtcagatttttaaaaaaatctacaatagaaaattcaatcattacatcctataagctgtcaagttttatttttgccctcccccacctgctgccttgttcaaggaaataaaagggttaataatgcagaggcaagcactctgtaaactgtaaagtgccacaggagcagaaggaactatataatccttattagaatacccctgaatggtttcctggtttctatggatatttttttctttttcttttttcttttttttttttttttttttttttgcctttccttggaggcactttccctttgggctgcagatctgcagaagccctagtcggagattttaataagtgcataagaattgtactctgagaaactaaagaccactgaccaatacttcattatcttttctagaacaccctgtagtgactgcttaggaactattagaatacaccaaataaatcagatggtatcatcaaagcttggcaaggaggggggaaaaactgaagagaaaagaaagtaatttcattctgaccttcaacaggttaaacatctgaatctataatcccaaatctgtttacagtcactgcagatactctgttcacttaggaaaaaaatttattatcccctgaagctaacaatatcattattagtctgctgctgctgggactgcatgggataaggacactttccaagccattaataaaaattgttagtaatttgcttcttaattatagttccaataaccactctgaaaatggaaagattgactgtatttccttaagggctatatattccatgccatttaaataagtatttacttctcactctgaaaccaatgagaacaaatttttattcattcacagcagcagcctctacattgctggaaatggatagttttcaagcttcagcaagtgtttattaagcaaaatcaaggagggctgcattgaactaggcactgagaaaggccacccctatttttgagaagctcagaaatcactaataaaatattgataggaatcaccagatatcatataaacaaatgcttgctattttgcaagaaaatgtacaaaaatatcagttttgtgcataaaagctgtcctgatatggtttgaggataatggttattactgtgcagtcatcaggagggatacacagaccccttttatctcccccaaaagccatgaaagtgtatctcccctcagattttcatcaatcatttgtatgatgtgattttcatttcatagctggtcaaaacccaatgaataaacaaaattttgtctttcttcaagcacagctgatgagagagaaagaaacatggtctacttcatataagccccatccctcccccaagagagttatagcattgctaaagaaccaattcacacatccttacttacacttgctgccaccaggtgggagaccatggctcatttcctgggaattgaaacattttagaaaggaaagaaatagacatgtttggttcacagactgactgtgttatcctggtagctatttgaaaagaaaacatgagcccccttttctcagtcaattgcaggttctgaaactttcctgaaattccaaaaaagagcagactacaaggctgaaagatgttggttttttgctacaataccagtcaacaaaattatctgggagaaacttgcagtcatattcaaacacttggttttgctcatttcatcctttgaattatcaggatagtttcatgcttgctatggaggatttcattgcatgatgagacctgtattttgttttgttccctgacattttgggcacatatgtatagtatgtgtgtgtgttaggggtgtgtgcacgcctgtgcgtgttgcacagttttttccccccaagcttgcctcgaggaggcagtgtttgaaaacaacatcaccccagctaagatgacaacctgtttgccttgaatgttaagatacaagccagctggttgcaggtgccatttgtctgaggaagatgcaggagagaatgatcctatcactgaagatcagatgttcccagctgcaccagagagcaattgcatagcaacattgagggtgttgtaaaagggtttggctccaagcaatttaatttgagcacgtacctagatcctttacatccttcaaaattctccagagccactgattagttaatctgcatggccttcttaacggatggtcgtggttcttaaccccattctacagataagtgattcaacaaatgtctggctctactaagggcaaagtcaaacccctgggatcctggtctcctgccagtgttgccagatgtctgtgggtcagctagccagcacgtctgagtgggcactacgtagaggaaactaatctgattccccttaccttaatcttcctcatctgtctggcaatgacattttcctgtcaaacaggtaggagatgctttcgcatgggagcaggggatgcttttcactgggggaagggtcctggtcgccagtcagcctttcagaggccaaaggggagatgcattctctgggtattacgtccccacgtgtcagtttcacagccatgttcccaaaatttcgcttaagatggccacaggtcaggtgattcctgcttgtctctttcccaccagcttaatgcaaactcttccaaaaagacaagatcaatcacccggtgagggtgagctcccaaatctagccaccccaactttgcccttcttaagatcactgcaggaaagggtattttcaggaaggggagggatacatcccctggtgagagctagggtgttgaatttttaaaaacttatcagagtctcccaccgtcatgttttatttatttttaaacctctgcactttcttttctctgtgaaacttttcattttagccttctttttcagttattcgtcattgcagatattttgcaaactcaagcctccctactaagaactcaggaagcaaccaatgcttccatttcgtgatgccaatctgccccctcccctcccgcattctacattctataagtgtgcggtccacagcagaagggttcctgagccgtgtccttatggtctgctaggcagcaggatggaccggtattgttcgtgtgttgtgttattcgtttgtgtgtgtgtgtgtgtgtgtgtgaatgcgcgcgcgtgtgtatgtcttcctgcaggggaagctaaattgaggtgtgtgtgtgcattatcctggttttcagttttgtggaacgaagtttagggtaaaggaagagtagggagagtgcagagaaagcaggaaagacaggcatactcccgcttaagagcagacggggtttcagggtccaaggtaaacacgaaaacctttttcctccctactccccttgggcgagtgccagaagattctccactcatcttttcccggctaagtgtaacgatttagaaggcgtcgcggtagactggtagagatgaaggttccccttcacacgttctgcaatcccaactcctattttcgtgtctctaaaccaggactcctgtaccattccaattggccctggtgcgggatgccagttgccccgtttgtgacgctgcgcaacattgtatcactgcgtttgcacctacctgctgggaaatcctgcagacagatggaatggtggcttcgacacacgcatgctctccccctcctcccggagaaccctgcccttcccctgcagtgcgcgtgggcgccgcccatcccctcgtcctcaccaggagtaccagctcgaagcagccggcagaggcgccgggcacctccctggagggccgccagttgcgcccagctgaggcgccccctccccagtggcagggagggggccaagcaggcgaaggctccgcagcttgggcctctgcggcagtgaccgcggctaagaggtgtgtcccaccgcccccactcaatccgtccgctatgtattcggggccagccccaaacacttctccaggtctcttgcgctccccgagggtatcttcctcctctctttcaagatattggcgctcaccgcactgtcgcttctcttcaaggggaaaactgctccgattcccaccccctgctgtcacccccgtttctagccccaaacagcccattctcgattcccacatgttgcttcccgcctcccaaccccttcccattcccccgggttccccatccctgcatctttctcagcatcttggccagccagtgccagacaagcgggatgcaaggggtacccggagtcccgcgggctccatagccatctgacttcgccttgcttcttttccccgcttcagggggtcttttgcttacctttattctggaccacgacattggcgttctgggcgatggcgatggcgatggcgatggcgaggtctttagacctctctctcgagtgtccaccggacattgcaatagacatggtgctggacttggacggaactctggagccgcctcagggcagaactctggggccagctctgtcacaggttctggggtcggctctggggccagctctggggcaacttctggagtcagctctggggccggctctgggaccgactctagggcaggttctggagtcggctctggggcagactctgtggcaggttctggggccggttctggggccggctctgtggcaggttctggggccggctctgtggcaggttctggggccggttctgaggccggctctgtggctggttctggggtcggttctgtgtacagttctgtggctgattctgaggtcgcctctggacagggacctggagcaagctctggacagggctctggtatgggttctggcgaagcctcggagagcagcggcggagccggcggcggagccggtggtggtggcggcggcggccaaggcggcggaggctctggagactcagcgggctgctctccatcctgaggcggggcagtgccctgggctgcggcagctccgcggtccatggccgcacaccgcttcaggtctgggcagcctgagtccctaagcctggaaggctaaagtaccctcgggcgccccgcccactccagtccggcagcccctcgcagggtgccaaactttcccccatcccactccatggctggcttggctctgaggtctaacccgtgggcgctcagcgtctccctatgctggaacacgcccctcagtgtgcgcacacctcttcgtaagcagccacgggtccgatgggcgggaagcagaggggcttgcgaacgcggactgggcagagcgcttgatgacctcctagcgacgcgcgggaggggaggggagagacaaaaaggggagggggagtggagcggcgtggaggttggggggcgggctggagccttgccgtgtttaaccctttagtgacacgaatgaaaaaaaaaagccagaggcgaagttgagggtctttgcaatcccccaaccacttagctgctggtcagaatagcttccatcctgtgtctgctctctcacctcagcagcaggtgagcttagcctcggaccaacctcttgccccccatctccaagcctcgatgggcaagtaatgctttttatctaagccgggaaaagaaattaagcggcatggtgtgtgtgtggtgggggggggggggtgcggggggggcgggtgttcagcctcctttggattgaagtacaatttgaccctcttcggttttttgcatttctgagctttgccgttgggtacagagtttgaggtgattcgggaaaggagtgtgatgagggaggctggcgccccggctttccgcagcctgcagcctccccgagagcaagtcgagagtgccccggcagcagctgggcttcgcgctcgggagctgaggctatctgggcgtctgtctggctcgcctatgctataggagcctgccttgtgcttttagctggatttcccagccatcagcaggagtttgtttttccgccccccccaaacttgttaacgcgcgcgcgcgcgcgcgtgtgtgtgtgtgtctgtgtgtgtgtgtgtgtgtgtcttgggctggggaaattcactgcaacacccacacccttttcacctcctgaagcagtctgacattagagatgggagattctcttgggaagagaacgactgatgcctagcgcagcacctttcccaccacatcggaagactttagaagctctttctgttatagtcacgtacacatacacacaaaccatcatcttagtcagacctagactttagacgccaatatattaccaattgtaattaaaatttgagaagactacctgttaagccacagctgggtggggggagcggacgggggagaaatacctgtaaacctgatttgaaatatgacaagtgaatttatctcccatacacataatgctgcagttgtgggtagcagccttctttctgcagccccttctctagccatctactcccagaccatatcccccactattccctcttcttttgccaacggacactgacctagccagaattttctagaatctgcaacatctttctgttgcctatactatgtctcagcaataaataataccataagagcacagtttcacctaaatccctccaaagaccagaatctctggtgaggtctgcatttcccagatcctcgctgcagcctcacagcctaagcccacctttccagagatgtgttaacactgcttggcagctactaagctagtgcagggaccgtccttaaactctggggatgggaagaccaggagaagtgagccctatcaattccctcacgtggcagtcctccttccagtaaattcaccttaggagcccactctcttcaccctccttgggcttgttctcctttcccctatcccacactcaagtagccaagccgcctttaaccctaagagttcaggactgaaatatacaggtgccagatctcattattggatctggtgcattaaagtgccagatctgaccaaccagcaagtccaggactggagatcacttttctggctctcacaccttaatggaatccctgtccttagaaggggcagatatcccacatttaaattttgctttttactaaacccaacatgtagttagaagggctgaaggctgagcagtcacagagtaagatggcctcttgggttacagatggcctcttggggtttggcatagacagtgtattgtcaagcgagataccaccaggggacaacttggagttactgctttatgtatgtttattgaaactcttgtctataattctacactcaattataatgaggccaacatttatgatgtagactcttgctacaaggtcattttgagattgaatgctaaaatagttgcttgtacatggcttttgctccattagggtaggttactggagatatactgcctgaactgcattatgattagttttgaaggttttaaaaaattatttttcagcccatcattagctaccttattgcctcatatcatagtaagggttctttgtgtgtgtgtgtcgggggttccttagcccagcattgaataccatgctttacattggaggcagagtagagggatggccagaatggttgattggtacctgatttggggaggcacctttgctgtaactaagctacaccttcctctttcccataacctgctggtttcttaataaagttttacttagatgcttctgtattttcctcacaacctaacccaggacttgaggtcatagtcaggattcaggaaatgtctgttaagtggatgattcattgtaggttactggttaggatgtatttttctgccttgcttttcagcactatttgatatttcaaatgattaatgatctcctaagaggctctcttttaattaaacaatacagatttttaaaaaggcaaagaggtacataagaatttctttaaccagacatatctggaatgatgaccgtatccacagaggcttggatgaacatagttctggatgtcccagggcagaaatggtccttagcctgggacttttgggcatgttatataagttacctgattgggctggatgaaggatcgatcagtacaataggctcatatcttttgaatatgcaatgcactaccttacccaactgccagcatttactctgattctacccagaataaagcttatccaagccagcatggagctccttcaatttcagccgtgctcagagttctggagaggcaaaggagagaaaagctgagaaatgtgacaaaattaaatctcttctcccttcctgttttcatttcattttcattattgaatgagagagtggcactgtattgctagagtggaagcccttccccccttgatcagtagctttaaattccctaagtcctcccttttagagcaatttgggaagaaatcagtgtctctcccgagtcttagcagctgccaacctcccctactgtactacctcgggatgtgccaagccaaaatagcaacctttataataatctactaaataaaataaggagatgggatgaagaacaggcagcatgtatggagaaggtagaggattcagactattaatttagctgggattaaaatgcaaacctgttaacctttactcactctagtctcctaggattaattgatataggattggagagttaaaaagttaataccttgcatttgtataatgcctttttatttctaaagtactttcacatatattatctcacttcagcctcacaacaaatgtgtgaggcaagcaaattcggacttccatcacatacccctgtcccctaccctttaacagatgagaaaacacaagtccagtgagactaagtgccatgtcttaggtcacagagataattagtggtggaacagacatttagaacttgtgtcactcaatttccagctgagggagaccagagcacaatactgagggctgtgagctgggggctgtgagacagggtctgtgtaaatcctcttcatagcagagtgggaaggctgccttaatgcctttttctttcttgagcttgtcaaaggagcagaggtttctcagctctcactctttctggacagcagttaatgatctgcaaccaagctcactataggaggtccctgtttagaggaacatttttgaatatgtatgtaatataataattcaaccagggtatactcattttattggttctgtttttatgttttcttgaagtgaagcactccacagttaagcggtatttactgccagtctgtggtgtatacagccctattaggtgtcctggggaaggagaaagggcagaaatattagacgtgatccttcccacaagaattattagagcttggtggtcaagataagccaaatacaggtgaaaagcaatccaaacacagatgccagtttatgatcatgacaccacactttgtacttttctggggggctgggggtgggtggggactaagtgtgacagagcggaaaggaaattgcaaggggagtcaggaaatctggcttcatattaaggttctaccactaaactctcaacatgaccttatacagatcatttaatgtctttgggccttaagttttctcgtatgaaaaatggaggtgggaataaagttgagcttgatcatctagctctaaagtctgttttagcacgaaatatcagcaatcctgtgagtgaatcacggacagctttttgtaaggggacagatcttgaaatggatcttgaatgatgcaattaacatagatcagcaaaggggaagtggaaaggcattgcagacaaggagagaagcaaagatagaaatctggaggtgagaatgagccaggctggttgagatagagggaacataccaacgactgatgagagatgagattagagtgaagcaagtggtagggagaaagcgggatgtaaaaggttttcaacatcagattgaagagttggaagatttggttttaaaggtaatgggagcaatgaaggctgtttgaatataggtgtacatggtaaaactaaccagtgaggaaaaattgtccttgactgtgtatttggttctggaagcatctacaaatctgctttgtttccctagagctgatatccagttgatttgaggtaatttgtaaaatcatgattctttctttatttttgctgcaacctctagctttgggtctgcattgccaaggctgctggcccaactggcttaaccacctgcctatacatttggatttagtccataatgggtcatttggcttccatggactcaacatgctaatgggatttctaatttaaaattctaactgatgatgaatgaccaggggatgagagaaaggtctttgtaggtaagcaggagtgggatggttgtggacctcaaagcagattcagagactgaaaacagtttgaagaaagataagaaaaaaaatgaatctttgcagaatctttaactcactgtggcttagacatgggggaaagctgatgagaaacagccatccagtctaacctgccaaggatctaaacccagcttgtattaataagagaaaacagattgctctaatggcatagagaaaaaagtggtggaaattttggtgtggcagatcacaggtgtgtgtggggggatctgagggagggagtatagagctgatagtgtcccttaggtgatggtgtttagaaggagtgaaaaagattattagaaccctcctggtgtggtgtcagtaatggaggcaggcagacatttgtaatactcaatctcagtatttgaatatgtgtatgtgtgtgtgtctttatccaaaaaggaaaaaagataatgttagtaagaattgtctcgcacaaaattactttgttacctcaccaccctctacaaacgctttatgactgactttaagagggaaagtgatggatataggagggaggaacgaatagagaaaggaatttaagaaaaagaggtgttgataggcagaactgctgtgatgaaaaaggttggggaagaaggtggctttcttttcctccaaagaactgccagcagcctttccagctgtccctttttctctttcttgtagttctcccttactgagagttagctcaaaatgcagaattaatcagttctgtcataagaaggaatctcaggggagaggctttacacaattgaagtgacttgcaaggacaaggcgtcacagaactcagttgtcttagatggagattaaagcattcaacagtcatttccaggacctcccttctatcattcaccttttggttttaagtccccatgctctagttatgacctttaggcatggccatttctggaagggcctattccctttaaccacacttcatatgacagaactaggctcagtttccccctttctctttctcagcttcactggtctctgcaataacaaggccctttcccaactgggtctcagaaccttaacgtggccctggggcaaaactgcagcagcctgacacccagggtttctagggattgcattattcagtcatcaattccacaaataattattgaacatctactacatgcttggcactcatttgaatgctgaggattcaccaaaaaacaagacagacatcatccgtgctcaaatagcatttattggctaagggctggggaaatacagacatacatacatgaagacgttgtttcagaaaataagtgcaataaagaaaacaaaaactgatgatgtgatagaaagtgcctggagggctactttggtcagtcaatttatttactcatttgcttaatcctatagcacatccaaaatagtttggaattacttcaccaatgctactaccaacaacaaacctactaaataaacttcaagattttttttccaccaacttctgatttgaaaacttttcaatcctacagaaaagttgcaagaataatacagtgatcacttacatattctttactgattgctaacactttatcacatttacttaatatctataactccatctatttatctgcatatctacctctttatttttggctgagccacttgaacgtttgttgcagacatcatgacatgtcacacataagtatttcagcatgtatctcataaacagcaaggacattctccttcatacacaatacaatgatcacacttatgaaatttaacaatgatacattaatattatctagaatacaatgcatatttgaatttctcaaattgtccaaataatgctctgtatagcttttttttttttgtaaatatagggtcaaatcatagattgcatttagttctgtgtctttagtcttctttaatctagattactcccagctttcatttgtctttcatgacattgacacttttgaagagtacagagcagttgtctttagactggatttcagtttcaatttgggtttgcctgattgtttcagattggattgtcatgaaaggcttctctgaagaggcaactttcagttgagtcttgtcaacaggaggaggcagctgtgaaaatatctggggaaagggattccaggcagagggaatggcaagtacaaattcctggagatggagacaggcttgtgtttgagggagaaaaagcaggccagagtgactggagcctagagatcaagggggagagtcccatgaaatgaaataagataggcgggattcagatcatgatgaagcatataagtcatgggaaagagaagattttgttctaattgcaatggtaagccactaagggttttatgtaatttggtgacatgatctgatttgaatttgcttttaaaaatagtttttacaccgcatgttctcactcataagtgggaggtgaacaatgagaacacatggacacagggagggtaacaacacacactgggacctggggttaggtggcgggagggagagcatcaggataaatagctaatgcatgcggggcttaatacctaggtgataggttgatctgtgcagcaaacctccatggtacacgtttatctatgtaacaaacctgcacgtcctgcacgtgtatcccagaacttaaaataaatacaataaagttgaaaagaaaaaagaaaaaatataataaaaaattaaaaaataaaaatagtttttattttctaaagaattttgctttgtatgcagtttaaagaaacaaataggtacttgtcatagctgtcaacctgcccccctctcccattatctgctccctagagggaactacttggagctcctttagctaaatagcatgcttgtaaagctaattcataatttttcagattaaagcattctatggaagaggagagtttagttcattatcaccataagcccccgtgcatgcacaaacacagacttcccattccaccactctaccagtacagttatgtcataattttgactagatcaatattcagtgtttacattattatgactctggaaatgctattcacagctgagttacatagcacactaggattacttttcctttcttgcacatctgcttgtttttaatggagccgataattgtcttgtttattctcttgcttatttttctacgtacttaacattagctcatccacaacctgttccccagttgactaaatattctcccaatatgtgaagatgcattggctcttctgtcagtctcgtcttctgtgagacatctttgaattgctccaatatggcccaattgctctctagatctgtagagcactctcatcccatgatatccctaataattttgaagatatttcttcattgttttctagcttctaacttttgagaagcctgaaaccatttggaatcctgatcccttgtaatttttcttttctggaagccattgggttctttgttttgtccttaggatgcaacatcacattgatctcccctggtgtgtgtccattttctttcactgtgttgggtattctgtggaccctttcaatcttaaaactgtctttcaactctgggaacttttgttgaattatttatttaattttgttctctccagtttttctgaccttttcctccctggaactcatgttattcttatgttggactacctgaataatgtaatttgcttacatttttcttattctttccatgtgcttgtctgtttgctctacttctgggctgttccctcagctttatctttcattgcttctgcaatactgcaatgcaattctgacactaacagagttagcagagactctactggttaagggcacagtctccaacaaactgttctcacttcagatgccagctacaagttcagggttacctgcacttctgaccaactggctaccaacttgggtattccaatgagcccctcaggtttgatgattccctagaataactcacagaactcagaaaagtaccatgtttatgattacagttttattataaaagatgcaaatcaggactagccaaatgaagagacctacaggatgaggtctaggagtgccctaattgtggagcttccgtgtcctccccttgtggaatcaggatatgtcacccctggcacatcaatatgtttactaactaggaaattcacctgagccttggtgtccagggttttcactggggtttcattatacaggcatgactgattgaatcattgatcatgtgattgaattcagtctccattcccccttcttccctccccagaggtcatcttcgcctgatatcatctggcacaaagccccaactctctagtcacatggttgttggtcttttcagcctcaccaacccccatcctgaaactatccaagagcccaccctaagccacctcattatcataaattcagtcatgggcccagaggcccatcatgaataacaaagacactcttatcactcaagaaattttaagagtttagaagctctttcccaggaaactgagacaaaggtcctgcaacaaaaaccagacaaatttttcattctacaacattttctaataagaagttcaaagcaggatttttttaaaaaaaaaattcaacttttattttagattcaggaggtacatgtgcaagtttgttacatgggtatattgtgtgatgccaaggcttggagtacaaatgatcctgtcatccaggtagtgagcatagtacccaatagtttttcaacccttgactccctccctacctcctgctaagtagtccccactacttattgttgccatctttacgtccatgagaacccagtgtttagttccaacttataagtgagaacatgtggtatttggttttctgttcctgtgttaatttgctcaggataatggcctccagctaaagcaggaatttttcagagcaattttttgccctctgagtatccttttaaatataatcttgctcttttttgatagatacaacatcttatctctttgagtacaataatggttattaattttcatttctgtttcttttaagtttttggtttattggttggtttaggtttctatctttgatattggaggctttcctcagatagcttgtcatccttggctgtttgctcatatttatgagtaggttcctaaaaagctaattagaaggtcagagtatttagtgagacttgtgtgagtatatcagttttctactgtggcgtaacaagttaccacaaacgtagtggcttaaaacaacacgcattaataatttcatggtttctgtgcattaggagttcaggtctggggtagctgagtcctctttcaagagtctccccagattgtaatcaaggtgttggtcaggatgtaaactcatctggagttttgattggggaagaatttgcttccaagcttaatcaggctgttggcagaatttattttctaatgaccacacgactgagggcctcagctttttgctaactgttggctggaggctaccctcaggtcctagaggccatccacagctccttaaggagattggcagttacttgccatgtaggcttctgcaacatagcctcccatttcatcaagcccagaggaagagacattagcttctgtctgctaaagcagagccttttataatgtaacttaactatgagagtgacatcccatcacctttgccatattctgttaggttagaagcaagtcacatttcccatctccattcaagaagagagaagtatataaaggcatgagtaccaggaggtggtatccactggggattaccttgggtctgtctaccacaatgggtttcactgcaaggtgatctggctgggtcatttcattggacaaccctttatatcaacatctttagggttttttttctttttctttattattatttttttctgaggttgttcacatttccacagaaggatattccagcctggaggttgtaagcctgactgtcagcattctaagaactaagtggggccaggcacggtggctcaggcctgtaatcctagcactttgggaggccgaagcaggcagatcatggggtcaggagtttgagaccaccctggccaacatagtgaaaccccgtctctactaaatatacaagaaaaaaaaaattagctgggcgtggtggtgtgcacctgtaatcccagctactcaagagggttgaggcaggagaatcgcgtgaacccaggaggtggaggtttcaatgagccgagacggcatcattgcactccagcccaggtaacagtgcaagacaacatctcaaaaaaaaaaaaaaaagtactaagtgggataagaggctaagagtatcaacaatcaatatataaacttctgaatgtccttgttttccatatggtacttcttcctcaactgtgcttccgcagtccagagaccctctgttttactctctctagagaataaacctcacatctgatgggagttggggcagagacaatcacacaaccgtgaggagttgtgggggagatcttaggatccaactggttaataagaatttcaaccaatactcttgtttttagacttactttcacctccacttccagaagtactggtactgccaatttttgagccttttggaggttctttattgtgaattgtgttggttgtcaattttccccaatgccagttttggattcagtttctgcaggtcggctgtcagttacccttgtatgtctattttctagctttaaatattgcattgttgtcttctctccccaaattactgtcattttaatgagggttggcagcgaagtggaggtaaatacacgtgttcaaattgtcatggtcaatgagatgtcctaatttacatgttaaaaagattactgtgacctttttgtgaagaagactatgagggagggataacagtggaagttgggagaacagttaggtagctagttctaacagaagaaatagatagcacttggtagtagattgagagtggggagaagagagagggaggtgtcaccaatgtctcctaagcttgtgtagtaggatggatggtggatttcacccattttgtgattcattgttttcatgtcattttccaggacagctatcaacacacttgtctccctcactactacaattggtgtcaccacaaaaccagctcagagcaaatctaacattgccaggaacacagttaccatgataagaaagccctaatgtaatgaccaccaccaacaactactactacaccagctcccagttatgaagtgatcactataagcctggttccataataagcactttccatatattattttatttaacttccccaatagccctgtgaggtagatacccatctgtagtttattatcattgaattccccaagtgaattctttctaaatcaatcaaattctggggagtatagtttcaaaacaaattatgacaggggctctagaagtagtaagagggcacatcgcattagctgttgccattcctactcatttgctgtctactccacacctgtggtaggatgcatctactctttgctcatactgcctgtccctctggttaaccacttcctcctattcttgcctcagaattttgcttcttctgaaaatcctctcttatagttgtattattgcccaaagtggcaagaatgtcccctttgcctcaactgtagcatggaactacagccttattctactccacaagctcttcataggagaaatggaggcttggagtggagatgagaactttgcccaatcttcaaatttatgtggaatttcaggaataaaacgcataaggatggaaatgtcttgaattgttcacatgaacgtagcctagaagagggcaaaaaagcggaacaggaagaagtaattttaatgcaatttgagactttccccaagtttcttgagaaatggaagagttggggggactgggaacagacggtacaaattacattaacttattatgaattacttggagtttttacccctaggagaaatcctggaaggatgtcttagtcagcccgggttgccataacacaataccattagactggggaatttaaacaacagaaatttatttcttacagttctggaggttggaagtctgagatcagggtgcccccatggttgggctctaggaagggccctctttctggcttgcagatagctgccttctcactgtgtcctcacatggtggagagagagaaagagagcaagttctctggtgtctcttctaataaggacactaatcctattgaattaaggccccacccttatggattcatttaaccttaattaccaccttataagctctatcttcaagtcatgttgggggttagggctttaacatacaaatatggggggacacaattcagtctatagcagagattatgctctgctttgccaagtcctcttgggttcttcccccctagtgttaatcaatacaattgagaacagaggacactgacaatcaagtcaatcagcaaacataggtgagatttgcctagacccctgtgtttccgttgtaacattagctctggcagttcctgtagagctgacactctttgtctctaaccatttatgttctgcggagttctggttggatttttactcctctgtaaatttctttctactgtgttatattaggcttcatcaagacatacttctatgatgataaatgaggtggccagattgactgactatgtactaaaatatcattgactttccttccttgaaaaatgttctttttgtatgtgtgactggtgaagggggtgatggtaattcagagtatagagtttgtaaaagatatttgacttctttggagacaagagtgatgggagaagattttgtagtcttgacgacatcacatgtgtgctctttctcctccatggaaaccaaaatgtgtgagtgagactgatgagtcagctaattctcactcccctcctccactcccacctccaccactagcctaaggactagtgtttttctttttcaagggcaagagtgaacatactaaagaatagaaggggatatcacagtgccataagtaactaagtaacttagtttctcagttattatagtcctgattcctgctagagagccttctgttattactctaggtaccttcagaacagtgcatttagccattcacggtgaatccagatatttgagctttattattattttttctaagatatcttgatatagcaagaggtttgagctttaaatagtccatggttctcaatgcatgaaagtctgttttttggggggttttttttgaggaaggggttagtgtccttttatgcagccaaccatattcattctttcaccaaacatttattgagcacttattgtgtgccaggcactgtggtagatactggagatttaaagacatgtaagaaacaatttcctgcctttgatgcacttatagctccacatacggatctctcttccagagatagtcccacatgaatcacctaaacacagaataataagtttgatgattagatgcctggacaaagtatgggcttttgttttgctctggggaagcagggaaatgttcacaaaggaggtgacatttgagctatgtttcaaagatggagaataaggaaaaagttattttcaggcattaggaaaagcacatgcaaagacacagaaatgtaaaggggcacagagtgttcaaaggtctgcaggaagttcattttgattgaggcaatgtcaggtggtcttgctaaaaagggaagttagagtaattatgaggaacctccttatgccatgctaaggtacttggatttagcattgaacatttttaggcagagacatggcatactattataggcaatttataaagttcactccaacaactacatggaggacagtttgaagggaggcaagaatggatgcacagagacagattaaaaagctgttgcaaaaatcctagtgtgaggatgataagggtctgaacaaaggcagtgacagtggaaacaataaggagagaatatggttaaggggtgattccaaagaagatataataggactttgcagccaattgaacatagttattggagagagaaaaatgttttgtgtgactcccaggtttctaatttaggtaacttgatagatgacagtgccattaatagagatcagttggagacatccaggagacagttgcatatatgggtctggagtaggggagagatatgaaagtcagagacaaaaatttccgtatcatcaatggagtagttgaagccatgggaatggagaagatttccctgggcaagtttccagaatgatatgagaagagccttatgaagagggtctctgaaaatagtaacctctaaggggtagatacaggaagagaattttatgaaggaggagaatgaataatcagagagataggaggaaaacctgaggagaaggaagatatggtccacagtgtcagatacagcatagacgtcaggaaagatgatggcaggagcagagcccacttgatttagcactcaggggtgttagtgaccttaaagagggtatattcagtagaatggtgccaggagagcccagcccaagtaggctgagacacaaatgggagggaaggaattggagactgagagtacagactactttcttcttttttttttttttactttgacatatggatttataaacattctaataacagtgcacctcgtcctgagggtctcttgtacactgaagtatacagccaggatgatcagcaacagatactttttagttgtatctaatattagtatttatttttgtatattgtgctgtggtttatatataatatatatgaataagtatacatgtatgagggtatcttttggttctgatagggtgatgaatcaatcacagttttggagatcccttctggagagtaaggtctgcagacctactgacccctttggttctggaaaagctcctatctgcctcaaagcagcctcatctccagtgcagggggaaagttatcatgcagggaatgcaactctcctggaagcatttgaatttacccaagctgggaacattcctctctccattcgcctttactgggcttaaagatttgtctgcaaatggatctggtaagcactcctgagtccatcaaggttcctcaaggcagtcacaaagactaaattctgaaatccacagaggtgccatcttgccatctcaggcagtgatggtcaacacttttttcactctaacacacctgaggaggcctgactctatcagtaacagtaatttcttgacagtgagccaggaggtgagataataaagacggaccacttttgttaaacagccagacactgtcctcagcattttacatcaattaagtaaattactatgtccccaggatacaggtatggaaactggttaagaagtgtggtggtgaaggaagagagaaagcaaaagaaacacatatggagaaggcaggtgtggtttgccactcaactgaattctcatctgaactctgtcctcttctctgaagaagatgtagactgtgtacctggccttgtgttggagcaactaggaatgggtaggagatgaaaatggcaacgttcctaactttaaggtgcttatgtactgtttggctagatttgttgtttatttcttaagaaagaaacatggaacaataaagaataggtggtgtttttaaagctgggttgtaaggcagctgcttggaacttgaagttcattttactttgggaacttactaaagatatataccttttataggtggatccataaatccagtttgtccatgacatagctggaatgctatacatttattaggaaaattaatatgaaataatattgttctggtactaataattaagcaaaatgaactatcaagttgaacaatacatgagttttaaatgatagcacttgaagaaaagctggtttaattacgagtggtgtaaaagatgaagaaatatacatgtggagattctgaataagacttttggcactttcaaggactttagaggatactgcaaagtttctttatcatggttaattttattttaaagcatatgactcttcattctttaatttgattgaatcagcactgctcttatacttgtcaaccataattacagcttttggttgaatcatgaatggaacaaagaagaaaacgttaaggccaccataggttcatggctacctaggagtggtcacattttcatctcttaaacattttccccttaatttctgtccatcttgttttctcagtatgagttaggataagcaattatagctgtcataataaacaatctcaaaatctgtgacttaacacaatgaggatacattacttgctcatatgattgtccaatgttttcagagaggagagagattctctggtcctcatagtcattctgaaatcaagtttctcccatcttgtaatttggccatattccacatatggcctctatggtcactatagaagtgaaagaaagggagcagagggatttgttgtagattttagtgcccagacctagaagtagaatgtgtcacttttattcacattcctttggccagaactagtcatactgtccacctgtgacttcccgtgtgcccaggagaaaaacagagtggtttgctgaacatatagcaatgtctctgccacaatgtccttcaatacaaaatggctaaataaactatgtatgtcttttcttttttttattatactttaagttctagggtacatgtgcacaatgtgcaggtttgttacatatgtatacatatgccatgttggtgtgcgtgctgcacccgttaactcgtcatttacattaggtatatctcctaatgctatccctccccccacccccacccaacaacaggtcccgatgtgtgacgttccccttcctgtgaccaagtgttctcattgttcaattcccacctaagaatgtgaacatgcggtgtttggttttttgtccttgcgatagtttgctgagaatgatggtttccagcttcatccatgtccctacaaaggccatgaattcatcagtttttatggctgcatagtaatccatggtgtatatgtgccagattttcttaatccagtctatcattgatggacatttgggttggttccaagtctttgctattgtaaatagtgccgcagtaaacatacgtgtgcatgtgtctttatagcagcatgatttataatcctttgggtatatacccagtaatgggatggctgggtcaaatggtatttctagttctagatccttgaggaatcaccacactgacttccacaatggttgaactagtttccagtcccaccaacagtgtaaaagtgttcctatttctccacatcctctccagcacctgttgtttcctgactttttaatgatcgtcattctaactgatgtgagatggtatctcattgtggttttgatttgcatttctctgatggccagtgatggtgagcattttttcatgtgtctgttggctgcataaatgtcttcttttagaagtgtctgttcatatactttgcccactttttgatggggttgtttgtttttttcttgtaaatttgtttgagttctttgtagattctggatattagctctttgtcagatgagtagattgcaaaaattttctcccattctgtaggttgcctgttcactctgatggtagtttcttgtgctgtgcagaagctccttagtttaattagatctcatttgtcaattttggcttttgttgccattgcttttggtgttttaggcatgaagtccttgcccatgtgtatgtcctgaatggtattgcctaggttttcttctagagtttttatggttttaggtctaacatttaagtctttaatccatcttgagttaatttttgtataaggtgtaaggaagggatccagtttcagctttctacatatggctagccagttttcccagcaccatttattcaatagggaatcctttccccatttcttgtttttgtcaggtttgtcaaagatcagatggttgtagatgtgtggtattatttctgagggctctgttctgttccattggtctgtatctctgttttggtaccagtaccatactgttttggttactgtagccttgtagtatagtttgaagtcaggtagtgtgatgcctccagctttgttcttttggcttaagattgacttgtcaatgtgggctcttttttggttccatatgaactttaaagtagttttttccaattctgtgaagaaagtcattggtagcttgatggggatggcattaaatctataaattatcttgggcagtatggccattttcacgatattgattcttcctatccatgagcatggaatgttctttcatttgtttgtgtcctcttatttcgttgatcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattagttttgtatcctgagactttgctgaagttgcttatcagtttaaggagattttgggctgagatgatggggttttctagatatacaatcatgtcatctgcaaacagggacaatttgacttcctctcttcctagctgaataccctttatttctttctcctgcctgattgccctcgccagaacttccaacactatgttaaataggagtgatgagagagggcatccctgtcttgtgccagttttcaaagggaatgcttccagtttttgcccattcagtatgatattggctgtgtgtttgtcataaatagctcttattattttgagatacgtcccatcagtacctaatttattagagtttttagcatgaagggctgttgaattttgtcaaaggccttttctgcatctattgagataattatgtggtttttgtctttggttctgtttatatgctggattacgtttattgatttgtatatgttgaaccagccttgcatcccagggatgaagcccacttgatcatggtggaaaagctttttgatgtgctgctggattcggtttgccagtattttattgaggatttttgcatcgatgttcatcaaagatattggtctaaaattctctttttttgttgtgtctctgcctggctttggtatcaggatgatgctggcctcataaaatgagttagggaggattccctctttttctattgattggaatagtttcagaaggaatggtaccagctcctccttgtacctctggtagaattcggctgtgaatccttctggtcctggactgtttttggttggtaggctattaattattgcctcaatttcagctcctgttattggtctattcagggattcaacttcttcctggtttagtcttgggagggtgtatgtgtcgaggaatttatccatgtcttctagattttctagtttacttgctcagaggtgtttatagtattctctgatggtagtttgtatttctgtgggatcagtggtgagatcccctttatcattttttattgcatctatttgattcttctctcttttcttctttattagtcttgctagtggtctatcaattttgttgatcattcaaataaccagctcctggattcatcgattttttgaagtgtttttgtgtctctatctccttcagttctgctctgatcttagttatttcttgccttctgctagcttttgaatgtgtttgctcttgcttctcttaaactatgtatgtcttttctatggaacattattcagcactttctaaagaatgaaacatctctatgtggactggtatggaaagatctgcagaatattttgagatcagaaaaaataatttgggaatgatatgttacaatatagtaacactgggatttaaaacaaaaaacaaaacaatgcactgtgtaaaaatatgtattctgtatatgaatgaacatgtgtagaaaaagatttagaaggataccaaaatttaaactgtcaacaatggttatttctagggaggagaggagtggaccttggttgttgatgatatgcaaaatggaccttatctgtaactttcaaaatatttataaggaaaatgaattcatgtgttatgtgtataagtaaaatttatataaaatagatatatttgaaaatatgcatatttgttatctgttcctaaaacagatttcaactgtgagtttagcttttgacttgttgagtttaaagagctaatgaaatatctaggttgttgtcagtgatgacaggtctggcaggcagccacagatgcacgtttggagctctggggagaagctggagttacagagttaatttgagtgtgttttctttgcataggggtgagtactgaagctaaaagagtgtaagggacctcaaaggtgatgctcctcaaagcatcaggccatgtcaagaggagacacttgtggcagaatgtaattcattgcactgcttccttcactgagaaagctttgttaccaaaaaaatgccagctgaactaatgtatgtgtttagcgatgtgagtgatttacattctggacaagctccttatcttgtcgtgaaccaataactgacagtttgctgatgggcattggtacatggactacagtttgagtagcagctctctgtggaaggaagaatctagcaagagaagagatttcagttgtgaacctttggatgtgaccatacttggagggggtagaggagaaagacttatcaaaagaaaaagaagtaataagatactgaattaatgtacagtgttcccgggtcaggtgagagaaagtttcgagtggtcaacagtgtcaaatgccatgaataggtggtggatgagagagggaaagccactggagttaactctgtgcatgtgtgcacatgtgtatgcttgcttatatttggaaagacctacaatgttactgagttcttattctgtgtcaggaactgtgtcatgtgctctacaagtatgacctcatttcttgggttgactgatgaaaaataaaagagtgtatgacagtggtagggatagaaccagagtgctggaggttaaggaaagggtgagtgggtggatacaggcagtcattgcagagaagaaaggtgatgcaaagaaggaaatagaatgttaggtagaaatgtaagaggaagggaagtctagggagctcacttaggatgactttgatttcagtaaggtgggaggcaagattgagtagagggagcatgaaagagcaaagaaggtatgtgacagatgttgtggggaatgtgatgggggagccaaaagctacatgtgtaaaatgatataatcgagacctcttctatcaaggctcagaagggcagaaaacacaaatacagagggcagaggttacttgtgtattggcaaatggttaaggtggttgagaaattggtgctcccaaccccctattcactttttcttaatcttgaatttacaatagcttgatttctttcaagatcctatttcaaaaagacaattgtgacagctaaaaatccctcctctagattgggatgtcattgatgtgttgtcagagaaagctttggaggcttccagctcccctccaccttcaagaaatctgaaaagagccgggcgcgatggctgacgcctgtagtcccagcactttgggaggctgaggagggtggatcacgaggtcaggagttagagaccagcctgaatggtgaaaccccctctctactaaaaatacaaaaaattagctgggcatcatggcgcatgcctgtagtcccagctacttgggaggctgaggcaggagaattgcttgaacctgccaggtggaggttgcagtgagccgaggtcgcgccactgcactccagcctgggtgacagagcaagacaccgtctcaaaaaaaaaaagtaatctgaaaagaaaactaactcatgtaagtaggtccatagggccattgtctctgcccctccctaagtggctttcatgcagaaaagataacagggagtgtgtctgacctacaaagagatggaagattggtatagggtgatgctatcacatgaaatagtctggggctagggacaattgaagagattatactgcggaatgaagagtaagcctggctgattaatagcaatacgaagatgacagccactgagctcagggatcataaaattcctaatagtgtttgcagtgtgactctcaaatcatttctgtgcagattctgtctggctagtgagtactggaaatttcagatattcataggttcttatccccatctaagtcttcgaagagtttgaaatccactgtgctttcttttcccctcaccttgtttttcctttatcccttcccttgagttctttcttttatagattttgctgggtacatttaagtttgtaagctacactgagaaagagcagttctgaacacagtcatgagtgaaggcaatgaattggctatttcaaggttgaactggggagtcagctttgctactaactggccatgtaagcttggacaagttgtttccctctctggacttcagtttccacattttttaactgaagggcttaaactagatgaactaagggtgtgtattagaagtgaaaggcagtatgtttttgaaaatctggatacccaggtccccttgttggagcctcattagatatggagtagggcccaggtatctgtggttttataaagtgatttaattccccctttaacttctgccatgattgagggcttcctgaggccttcagcagaagaagatgttagcactatgcttcttgtacagtctatagaaccatgagccaaataaacctcttttcattataaattacccagcatttggcattcttttatagcaatgcaaaacagactcacacaagggatctccagttctagcataatatgaggggagggtcaggggagcggggggtaaagaaagagagagcacatacacgttttactctctggaaaggaggctatctattatttacacaattgaaaactggggagccaagacaatagtgtaatattttcacattattaatgtatagatgggttttgaaagacttagcagttaatgcacatggacactcacctgcctttcccaaagaaataactaaattggaaaagaaacagggcagaataaaagcagggccttcttcaggtaatgaatatagacatgtaccagtcatgggctcaaccctcaagaagcttgaattttgtgccccatcttttcctagctttctgacacttggtaagaactcccagactcactgacacttaggtattcagacttactgtgtttagaagtgttattctgccagggaaatttgcattttgaggaacctatgccaaagaactgcattttgaaccaatgtttatgggagaaatgtggggaaaggctgcctgccaggaggctgaaatctggtttttggatgcccatgatgatgtggggggaaccaaataattgaaagtctatagtggaaatggatgcctgcaatgggcgtcaagaatagggcagggggctttaagaagcagtggggagtgggcctttgtataaaccctacatggtgaattgttcactccagtagtagctggactagagataggaggttaaggaaatcaatgtggatgcttcagggtgaagaattcctaagcacaaattttagtttgtgggacaactgagagggcacacatatccaagttccatcctttttgaaatggattgttgataaggcagtatttcatagttgttccactgaaaggaaaagtccatctcagccaagtggactgtaaaatcagacctacaagctccttatctcccagtaactcccaaatccctaaggtgtgagctcaggcctgacccagtgccaacaatgtggcttggatgtggctagaaaagccccaagcactccccagggctggctatttgccatgtggctccattagcagtcaagaggagattctcctctagggccttcttgttgcacagagtagttgcacagtctcaggataaagagctggcttatagctatttgtgactggaggggcaagttctttactctaaaaaagcgaccctactcattgcccctctctaggcagacgtgcactatctcagcttccataattctctatttaaaatgcagttgctctgcaagcattcacaccttattatcatctaaaatctcttgagctgcttttagatgctttttgagagtgaagctctgggttaacagtttaatgcagtggtatttcgcatggtccgcagaccagcagaagcagcagcagcatcatctgggtacttgttaggcatgtaaactctcaagctctacccagacctaaaactctagacatgaagcacagtaacttgtgttttaacaagtgctctaggtcattctgatgcatgctaaggtttgagaacccctggcataatgagaggaatttgggctttggggccagacacacctgggtttgaatctgatctccatactacctaggtaacctaggataatgacaagagctaatatttattgaacaacgtgccgtttatcagataatgtgctaagcacatttaagggcttatcatgtacatatgtataggtatgtgtgtgtgtgtgtgtgcatgcgtgtagaattcctatggattaagatactgttattatcctcaatttagaggtgaggaagctgaagctctgtaagtgagttgcctgagatcccatagtggtggtgctcagctcaggtaatctggctctagagtctgagcttttaaatttctactcaacctaagcctcagtttcctcatttgtaaaatgaggctagtattaccctactttggagttttgaagaatagaaataatatatcttgagaccagttctcactaggcagtctagagcaaatgcttttagaaagaaccccttctgtagactctacagcatagatggtgctttttcataaagatgtcacccatagtgtaactagggcagcaggagagaggcacagctgtaggaagagtcacacaagctgcagctttaatccaggctaggccccttcctgcttaccatccccacctttcacccaggcctagtggagttaagggaagcagccctctctatggaaactcctcctctgcggtgattcaggtagaccccaagggatcaccttactgggaaactggggctgtactgcactcctccatcggtgatctctggtgagaacaagattgacagagaggcttctctcccagacgtaccctgcaagcagtttagagatccacatcctgttagtgaaaatgacaggtgacgtgggtctcagaaaaatgcctcttcttttctcatcttccttatagctcctaattggcttggggaataggtgtaagagagattccttcctatgcttcctattgaaaggttgccatggagacttggcccagcctttgcctctgccctattggcagtcaacaaatggctcctgggctcttatcctcattattgcaaatgccctttccagtggctctccccatctcaatgttgcctacagtagaataaaagtaattcattcatttaaactttgttagttgagaatctgctatgtgccgagcactgttctagttctggagaatcaggggtgaataaaacaaatgcctgttgaactaaattaaattgaatcagattgaacggctcatccctgggcgagacactgaactaactcagtgatgcagaggatcccaattgatttcacaataattcatttcacaaatatttattaagcacttactctggacaaagcactattctagctgctgaggatacagcagtgtctaaagcctttgctttaagagaacgtactttcttaaagaggaagacataaaataagtaaatatataaataggataatgatattagatgattataagtgctatgaaggtaataatttagaaaatgactaatgggatataaggctactttaaacaaagaggtcagatctcctaatgaatcttatttgagatcagaaagatgaaaagcaactggccatgggaagatctaagggaagaacactccaggcagggaaacagtatttgcaaagtctctaagctggaaataccttggcttattcaagggactgaaagaaaactggagcaaggtaaatagtaaaaagagttaggtagaggttgcatcattcaagatctgctagatcaagatagtttagattttgatctcatgtgatgtgaagccattggagagttctaggcagtggacatacgtgatatgatttgtgttttataaggatgctctggaaagctgtgtggaaaatggactgtgcgaggaaatgagtggaagctgcgagatcagtggagtagagatggcagtgttccatttaattttttaaagttgtgaccaagcgtgatataagcaacaaattacaaagactgaatatgcatgccttgagtttaaattagtgacttacaaaggtgtcaggctatattcattatgctgcctctcatctcaattaactaggaccccttcattttagagctgagaccaaggaggtctctctaatttacaaccctttttccatttgtaggtacgtgtgtatgtgtctgtgtgtttgcatatgcacgtgtggcatctcagtgtcttctcatctagttctctaaaattaattctgaccacacctaattaatatatatcccgaagaacaaaataagaaaaattgcaaaatttaaagtgatcacagggctggctattcttatacttgcagaaaaaaatcccaaaacccagtttatgaaatcttggacttacaaactagataaactagaagataattattcacattactcattattctttcttattgtttgctttccccagtcactaacttattcctttaaatagctatttccctagcacagttaagttttttatttacaaatcgtgaaccaatcattattgatcattaactgtgtgacagtggggctagagggcagggaaattcaattaaattcgttgaggtctactttgtacatataagaaagaaggtaggtcctggggaaagtacaaagataaataaggtaaatttcttgcctcctggaagcatgaaactgtgtgagggaagacagccagtacacaactagttataacatgaggcagcctagaatagaagtctgttaaaaaaagtgctatgaaacatggaaagagcaatttgttctgactgggagaaatggggaaggcttcatagaagggatttttttttcatttattcattcaacagccttcatcaagcacccactatatgccagaaactgtgatagatactgggactaccatggtaaacaagaccctaggcgagcaattacaatctagtgtgatcacataggctatgtgagggagagtgcagggtgctctgggaatacaaatgaatggcatcaaggctagccttggacaggcttggataggcttcttggaggggttatcatgtaagctgagatagaagagtacaggttgcctgggtaagagctgtggtgggaattggggacagtgttctaggcagaggaagcagcatctggtaaggtttagtgatgtgcatagggagaggaagagggggacagataatagtaattttgaattactgaatgaataaaaatagtaatttcctgatatttatttgaataagccatagctcgaatctactgcaggagatttttgtagaactgcttcttagaaatcagattcttttccactagccactcttaatgaatcgtctttgattaagacaaaggaatacccaataattaatagtgcaatagctctaccacacttctatattcctgactagtcctgggaaggttgaggaagaggggtgagacacccattcctgggtatttgtttcttctgcagcagcactgtgtcttgtcattgggtttcagataatgttcataggatcatagaagacagcagcacaaaactttttttccccggagatttgcaccccaaaccaatccttgtggatctgctagaggtgactgccttcatttgatagccccttttgtgggtcttttagatgttaatgaaggtcttaacacttactgacacgttgttgcagagataatcaagacgaccaatttaacaaatttcaaaagcactgtcttataatcatttattatatttaactacttaaacagtctccacaagtacacaactcatttcaaaaactgaaaacagcagaactttaaaaaacttttaaaaataaaatataacagatatacagaaaatacatgaaacataaatgtacagctagcaaattattttaaagtgaacaactggctaacccccaccctggtccagaaatagaacgttgccagtatatcagaagccttttgtatgtccctgaccaatcatcatctctctacccactaaatataattattatcctttcaatgtaattatttcactgtatttctatttctttatagttttaccacccaactatgtattccaaaactatatataatagtggatacataaagaatatatatagtatatatacaaataatatataattctgttttctttttgaatttataatgtaatatactcttttggcttatttcactcagcattgtgcttatgaaagtcatccatgttgttgcatgtagctgtacaagcatgccattgtgggaatataccacaatttatttattcattccattgtttctaggcatgtggataccttctgttcctcagttattatgaataatggtgctttgaaaattcttgtacctgtcttttgacgtatatatgcacacgttgcttttgggtatgtatctaagactgaatttgctgggttataggatgtatgtaggttcacataatgccagttttccaaagtgattgagcctatttacattcccttcagtggcatatgagagttcttattgctccacaccttcacgaacacttcatactgccagtctctttaattacagatattctggttgatatgtagtggtaactgattgtggtttcaatatgcatttccctgatcattaatgtggttgaacatcattttgtgtgcttaattggccactggaatatcttattttgtgaagcacctgttgaagtctcttgaccacatttacactgaaataatgcagtaatacttctgagtggatgttagagattatgcagaattttgtcaaggattgttgaacaaccttatgtggctggagtacaaggtgtatgtggggaacctaaaccatggaagatgggagtgatgtgatcagatttgcattttaaaatactttctttggaagcagtgtaatgaatggattggagggactgagaccagagacagtgaaacctgttgggaggttctttcaataatccttataagaaaacaatggtgactacgttaggattggggtaacagaaatgaggtttgagagatattcaggaggtagcagtaagagaatttctaactgatttgttggggggagtgttgggaaataaagggccaaaaatgactcccaccttttagaataggaaacacagatggtagagttgagattggatagacaatggatagcatttttgacaagctaatgttgaggtttctgtgagaaatctgaacggatctctccagaagtcaattgaaaatatggatttggagtgtgtgtgtgtgtgtgtgtgtttgtgtgcatgcacatgcatgtgagtgtgtgtgtatgtgtttttctgtgtgtcacagtttcttaaatgaaaatggctgactgcctagtcctaagaatgactgttattgcttgggaatgaaacagaatatctgtgcttgaatgtttaagatttatggttgctttaaatcagggtttctcaatctcagcgctattggcattttgggctggatgattctttgttatggaaagctgttctgcatgttgcaaggtgtttagcagcatccccggcctatacccactggatgccagtggcagaatccttcccagttgtgacaaccaaaaatgtccccagacattgccaaatgtctcctgtgggcaaaagcacccccattgagaaccagagcttcaaatgttaatttgggtattatctgtatatattatcctatataaagataataggtgacaggtgatatatatggagatatatatatatgcacacacacacatatatatgtgtgtgataatatatacagataatatatagatgacagctgagagcatgagaatgaataaaagagcccatgaaaagcatatagcaaaaaaaggaagttggctaaggatataaccttgagaaatgcctacttttagggtgtgagtgagaagctaagaaagacgaatgaaggggaacaatcaaagaggtaggaagacaaccaaaagacacagaggattgggaggaaaccccatcaataaggagaaagtggctggtcaatggaatcaaagggtacagataagtagacctagtaaggcctgggaataggggaggcaaggaacggctgtactttgcgggaattaattatttcacatacatacaggacagtgccaggcacgatactgtggaatagtcatatgttacctcctaagggggaatgctgctgccaagggcattataaaggagtaaactattaaaatacttatctcattgtgctgtaataatttgtttatgtttatttattatctgatcttccttgtgagaatctagagatagtgacttaaatattattcatctttgtatctgcaatacctattgagagtgtggcttataaatggctcaataaatatgggttgagtgaagatatgaaagtgtaattttcttccattgtattcctttggggccagagaaataaccagaaaaaaattttggcacatagacccatgaatttggattaggcaaaacaactatgatgagctgtttaatcaaaggggctatgagacttcaatcagatatagagacaaaggagaaattggtaaactggaagtaagggagaagttcaccatcttgatgagggtgaaatgacagagatagaaggattggaaggaggttttagtcagagaagaggttttccaagaggaaacagtcactgagttcctactctgtgtcagcactgtgttggatttgtcactgacaccttagtaaataaataagtggataaataagaaaattggcacacattgttataatttatcctcataatggctccatggagatgaaatgaggctcatagtggttaagtaacttatttcacattcatccatcagacccgatataggccacttagttgcagccaagtgaaagactgggccctcccaaagaaagctagtgggccagagggatatgccaggctacgtttcagactcttcatggggaggatagagaaattccctaaggaagaagctttaaatcacagttatcaggagggtatggcaaactgcaatgggactgggcagctagagtttctaggcggagttgataacttgcaatatatgcaggttcaaatcctgcatttgtcatttcccagcaagtcacttcaactctctaaatctcagtttttaatctgtaaaatcgtaaactgaaccttacaggttgccatgaggattatatgtgacaatagatataaggaacctttgcaaactagagtgtgttatgcaaatgttaggtgtcattatcatctcctacttctttttccattaaggcaattctagggactctttctatcctgtgcaagatgggatccatttcggcaaactgcatgtaaaccctttaatataatatgcagagatatatttattttcttgaaaaaaaatagaaatgccttaaaattggcatttgtcctaaaatgttaggtcacactgcatgcaccagagctgtcttcctgtagtaggaacatcttcaggggtttttccagcaaggcaggtttactaagaacagagtattctgattcccagtatgacctttggggtcaagacactttctgggaggagaagatggaaggagtgaataagcagccctgtcgtgtgttctccaaagtaataagcaaccttcagccatcattgctggaaagttgctgctctccatttctaccataaggcagttcgttggagaataagatcaagccacgatttatctggagagtacttggaatttccaggtatttaaaccacttgctctgtatgtcttgaacacctactatgtagctagctttgtgccagttgtgaataactgctctatacccctgatgaatgcacaggaaaggcagaaaaccctgtcatcagactctcagagcaaaatggatcccacaagcagagcagctggagtcctgagaaggcagccattattgggacttgatatgatctgcagggcaaagccttagtgaagatagagataggaataaatttggctaggtttctcatatctctgtggaaattttaattttcttgctttcacccagctttctataggagtatgcatgcacatgcatgtgcacactcacacatgcacaacacacatcctggatcatacaaatacctttcttgaatactcagtatgtgccaggcactgaactaggcattgagggcacaatgatggccaaagctatgcctcatttggctctccacatcaggctcttaaaatagctggacctcaagtacttttaatcttcagtcttcacaactcgcttcttattcttggccccagcctccttagggcttcattttctggtttttctttttccccatcacttttttttaccatttccccccaccacttgcttgtcctctttattttgagccaattgacaaataaatgcaaatatctacagctcaaccctaaagacatccctgagtcgccccttgcagttactccagactgtgttctaccctagagccctctttcgctgccttagccctgcagcaggcagaaagcagcactgctggttttcttctctgtcttcatcattgttacatcaaatgttccgaagtgtctaaagtccctctctcatcccttttccctcctcctccactcctctgccatgtttgttagttcttcatctcttcatcaaaaatctcttcagcctccatgtcttatttttcagtggcaatgagctttcaggccatctcattctttttctctgggtttttgtctagttctctgatttctagtcttttctcagctagatataaaacatgatctaactctggacagctaaaaaatatatatagtgcctattttgctgcctggatttaatcagattacatgtttatatgtgccttagagtgccttcagagaatcaggtccattcttaattgtatgcgctaattgaggttatcattggtactaataagctcagaatgatgtccttttggcttagagatgtatttaagaatttgttttacagccacctctgttcctaattctgtttttcctgggctgatattagaatgagtttgcatttcccaagcacacaagcattgttggcaaagggaggagggagcctggtggttgagagtggaggcgcctggatgcagcctctgcattggaggaggggcaaactcggactctaaatgaccacagataattcagaaaataaaggatccacaggctgataatcaagtggcgaatgtgctttaaacactgcggcaggcttcaagctatgatgaagtgtttttttggagctgctcttgttgcagctgtgaggttgcttttcgtgacagagcagagcagtactggggacactaactaggctgcagaggccagcctttgaggggccactagcaggtctaatgtctagtgtctaaagggtggggcaagcacaggccatcagaaaaagctgattgagactcagaggcccaaagggtagaggggttctcacagtcagggaattttggaaaattaacttattcactgtagtctctactaggaactggaaggttcagagatctaggtccagccttatccatatggactaagatttggagtagggctttaggaccagaggaatatccaatgttaagaaggacatgaagacagacagatagacactctgttgtacttcctgagttaacatagagaagttggagaaagtgggaaggaagatagggattagggaagtgctgtaactcagaggttatacaaaaactttgtgtttagccctagcactgccaatgaattgctagtgaagctattttaggtcccaccaagtggtagggctaaggatgcagatactactgatatttcatcaaattaaagatgcatgcttctgttttctttgaagacaaaattggccttgcaatcaatgacattttacaatggctcttagtcatttttcatttttggtgtttttgaaatttgtatgcaacttctacttgatgccattttagacttgaaatgtactatataccttgccacaattggctcatgataaggacagggctgagcttgcagtgactctagctgtgaagggttgagctaatgagggttgctgttcctttagaattttgacagccacatcccactgttggctcaaataggggcactgtcaaaacgaaccacaaatctatacagatcttacaggatcacaggctgatataagacacagttcttcattctgcattgcaccactggtccttgggacccagggggaatccttcgcatacattactgttaaatttaaccttgtttcatttaactcatcatcccattcattcactcagcaaacatttaatgggccaggttttgagctgggtattggaatacaaagatagcccgtcacctccatgtactataggggaaaaggtagtaaaaagactgatagataaatactaaattagaagtgtgcttagagttatgtggaagcacacaaaaggaatactcagtctaaaataaagtttgtgaaggatgagactagagtgatagattcacttagcctcttactagttgtgtgatccctctatgcctcaccctctttatggctaaaatggggataataatagcacctacccatggaatagtagggataaaatgagttaattcatgtggatcttttagaacacattttggagtacagtaagggctatataagtgttaaataaatcaaggaaggcacttcagcagctcgatcttgagcatttgagcaatttcataaaatattagttgcttaaaaagagcaggacaaaacctttcacgcagagtagggatagaaagaacatggtgcattttgaaatctaccagtttagtaggacagcatatgaactgtgtattgacaataacagaggtgtcggtgacagggagggtattaacacatgggactatgccttgtttggcatggtcatgggtttggattggatcttgaaaaagaggagtagcctttaaaaaattttaagtcataagaatttacccttccacctgtgaagtagttactatgccattttacagatgataaaactggtatgctgaaaaattaaataactttcccatagctatgcagctagtaatgaactgaatttggatttgaatctaggttccagagtacgcgtgcttaatcattatgtcataccacctctccaagaatacaggcaaaaaagtcaggcttgagggaaaaaaagatgactgtaatttttgacatgttaagtttgcaataaatatgtggtatccaagtgtttatgtcctgtaggcaactggatatatggatggggagtttaacaaaaggatctgagcttgatatttaggtccgagagttaataatgataggatataaattgagaaatttaaaatttgatggtgaaacctagggaacctcaaaaggtatcatatgggcagaggaaaaggagcccatagtgttgactaacaatgaacaccaaaagaattaggaagaaaagaagagtaaggtaacaatccaaagaaacagtttcaagaagaaagatgtactcaacagaatcaaatgctgcagggatgtcaaatacgttaaagatataaaattatcatttgggattatggaacttctatttccagtatggtgatgtagacatgtttttccatatcctgtttactaaatacagctaaaagccctggtagttatacatacaacaacaataagaagactctgaaaggtgtagaagagaaagcaggcctgctagagaccttgcgccctaaggaattaaatggagatgagtcccctgggtttactttgggcctcatacattcaagactgggtactagagaagtcagcaatccagaatcaccaacaggtgcaaacacacaaaagccctagaacagcctgttctcgctagacaaaggaccaggaaagggtaaaagtaacaagacagaaaactctgtaaccaaacacccaggaaaaactgtggccccactttcaccactgtcatcaaagaccagttggggaagctagactcccaccttggctaggctattacaaggcaccccaatcccacaccacccctgccagggtggtgtcagaaaatgctaagagtgaaactgagattttaattttcaccgggaggtaatgagaccctccttccatcgtgttagtggaaaccacatgaggaacttagactttcaatccacctgtggtaatgagggtgatatcagaggaagtcgtgtggagggttgagacgttcaacaatgttccccctgagtatcaacgaaggcttatggagaacctgggctttaatccaagcatggcagtaacgaagcagcatcctcccttccacacaagaacagagtcagaggaggcctgctaaacaaaagatttaaataagatacgaagtctcataataaaatatttaaaatgttcaggtttcaataaaaaataactcattataccaagaaccaggatgatctccacttgaatgacaaaagacaatcaacagataccaaagacaagatggcacagatgttagaattatctaaaaagaattttaaagcaactgtcataagtgtttcaaagagcaatcacaaacatgcttgaaaaaaaaatagaaagtcttagaaaagaaatagaaattctcagcaaaaaaggagctataaagaagaaccaaatggaaattttagaactgaaaaatacaataacaaaattcaaaaacaatgaatgggctcaatcgcccataatggagaagacagaggaaataatcagtaaacttgaaaatagaacaatggaaaatacccaatgtaagtaataggctgaaaaaatagcctcagggacttatgcaactataataaaagatctaacccccatgtaattggagttcttgaagaggaggttaaaaaggatgggactgaaaaagtatttgaagaaaaatggcttaaatttctccaaatttggcaaaagacataagactacagattcaagatgctaagtgaatccaaaacataatgaaataaatccatgctaagacacattacagtcaaacttttgaaaactaaagacaaacaatcttgaaagcagccatagaaaaatgatgcacgtcctataaaatgacagcaaatttctcataaaaaaacatacagactggaaggaaatggtacaagagtttttcagcagctgaaagaaaataacagccaaatgagaattctatatccagtgaaaatatcctttagataggatggcaaaatcaagatattgtcagaggaaggaaactaagaaaatttgtggctagcagacctatttactttaaaagaatggctataggaagttctaaaagcaaaaaaggggattacagaataaatcttggaagattaggaagaaaaaaaacacagaaagagcaaaaatatgagtaaatacaacagactttatgttatggaatgaattatgtccccctgaaattcgtatgaagttctaaaccctgatacctcagaatgtgactatatttggatattgggcctttaaagaagtaattagggtaaaatgaggtaatacggctttgcctcaattcagtatgagtgatgtccttataagaagaggggatttggacacagatatgtgctcacacaaaggaaagaccatgtgaaaagatagcaggaaggtggccatccataagccaagcacagaggcctcagaagaaatgaaacctgccaaaaccttactcttggacttttagcctctagaactgtgagaaaataaatttctgttttttaagccacccagtctgtggtattttattatggcagccctaacaaactaatactttcattcttgtaatttttatatttgatggttgaagcaaaaataaaaacactaaagttgttcccaatgtataaaaaaatttaggcaattaaattataagtgggggagtgatatggtttggctctgtgtccctacacaaatttcatgtcaaattataatttcccagtgttgctggaggtgcctggtgggaggtgattgaatcatgggggcggacttcccctttgctgttcttgtgatagagttctcaggagatctggtagtttgaaagtgtgtagcacctcctccttctctccctctctctcctgccagccatgtgaagatgtgtttgcttcccgtttgcctttgccatgattgtatgttctctgaggcctccccagaacgagaagcctgtacagtctgcagaaccatgagccaattaaacctcttttcttcataaattacccagtctctggtagttttttatatagcagtgtgagaatggactaatgcagggagagcaaagggacataaagggaggtaaggttcttacacttatctctaaatggaaaaatgttgacaccagtagaatgtgataagttatgtgtgtaaagtggaatacaaaaaaaaattgctaaaatgctatacaaagagttaaaataaaaactaaactgagctaaaaatgttcaagtaacctacaaggaagaaaactagagaactgaaaaacggaacaacagaaaaatagatgttaaaaataaattcatagacttaggtcctaacctatcaataattacattaaatacaaatggtataaatgcacaaattgaaagacaaaaattggcagagttaattttttaaaaacatgacttaactaaatgctatctataagaaattcactttaattataatgatataggtaggatgaacataaaaggatggcaaaagatattccatgcaagtgttaatcaaaagaaagcaggagtggctattacattatgtaatagtctttcttggtcaatccacctagaagacatagcaatcctaaatgtttttggacaaaccaacagagctggtttgtaaagtaaaattgatagaactgaaaggagaaatagacaaatatagaattatagttggagattcaataccctgtcttaacaattgatggaacaactagacagaagatcagcaaggatacagaataactcaataacaccattgctgtgatcgaatgtttgtcttccttccaattcatatgttgaaacctaaccccacactgatgatattaagaggttgggcctttggaagtaattaggtcataagaacaaagccctcaagaatgggattagtggctcaaggaggtttgttcatgccttttgtcatgtacagacacagctagaaggcatcatccatgaggcagaaagctagccctcaccagacaccaaatatgctggtgctttgatcatggagtttccagccttgtgagcaaaaatttctgttgtttgtaaattacccagtctaacgtattttgttatagcagcctgaattgactaagacaaccatcaactaacaggttccaattgacatttatagagcacttcactcaaaaacatctgaatatgcattacttttttattaaattattaataatttgtctatatattttttgcttcattaattaatatataaagtaatttttatttttatgtttttcttctccaactttaattttaggttctaagggtacatgttcaggtttgttacatgggtaaattgcttgtcactgaggtttggtgtacagatgatcccatcactcaggtaatgagcatagtaacttccaacccatgccccctccaactctcccctctcaagcagtccccagtgtctattgttctcatctttgtgtccatgtatattcaatgtttagctcctacttcataagcgagaacatgcagtatttggttttctgtttctcctacattagtttgcttaggataatggcctccagctgtatccatgttgctgcaaagaacatgatttcattattttatatgtctgcatagtattctatggtgaaaatacacattattttcaactgcttaaacaacatataccaagataacacacatcccaggtcataaaacaaacctcaacaaatttaaataaagtgaaatcatacagagtgtgttctatggctgcacagaaccaaagtagaaatcaataacagagaaacaaatgggttttttttcctaaggatgaaaggctgcttaaatatctgaaaattaatcaatgccatccaccacattaagaggccaaagaataaaaatcacacgatcatatcaattgatgcagaaaagcatttgacaaaattcaacacccatttttgataacaactctcagcaaattgagaatagcagaagacatccttaagttgataaagaacatatacaaaaaacctgcagctaacatcatatttaatggtgaaagactgaaagaaggcaaggatatccatttctgccgctgctattcaacacagtgctggaagttctagacagttcaataaggaggaaataaaaggcatacagataggacaggacaaaaacaattggaaaaaaaaaactgtttcaatttgcagaggacatgatagtttacataaaaaaatcccaggaaggtacaaaaactcctagaactaatgagtgaaattagcaacatcacaggatatgatatcaactacaaaaataaattttatttctatgtaacagcaaaaacacataaaaattgaaatttaaaatacaataccttttactattttgtgatgtctcacaattttattttgccttgtgctttatttggaaagaaatttttatcactgaaatttttttattttaattttctgattttgtccacagtacctttgtatgaatattgacagccattttctgttcatttttaaataaaatatttgcctggacagcaataacagttgcaaataaaatgaaacaaagtaaaataccattacaatcactcaaaaaaagaaaattaagcacacaggtgtaattctaacaaaatatgtgcaagaaccatatgttggaaaaatatataaattgagggacatactgtgttcatggattggaagatttaacatagtaaagatgacattatccttaaagtgttagataggtttaacgtaatccctatcaaaatcccagcaagattgttgacatagagaaatttattacaacatttgtatgaaaggcacaggtcctagaatagttaaaacaatctttttgaaatcctcaaactgaaaacaaccaaaatgtcctaaagcagatgaatgggcaaatcatcatatattcatattatggaatactattcagcaatgaaaatgactaatctattgatatatataacaacttggatgaatctcaaagggatcatgctgagtaaaaaaaagccattctcaaaaggtcacatactgtatgattccatttacatcacattctcaaaatcacaaaataatagagatggaaaacagtttagtgattacaaggagttaagaataatggggttaatggaggtgagtgagattatacaagggttgcgtgaggaagttctttatggtgatggtacagttcagtatcttgattgcagtggttgttgcaggaatcaaaacatatgttaaagtgacataaaactatctacatacactgtaccaatgccaatttcctgtcttgatattgtattataattgtgtaagatgttatccttgtgggaaactgggtgaagggtacatggaacctctctctactatctttgcaatttcctgtgaagcagtaattatttcaaagtaaaaagttaagcaaattttgaagaaaatgactttgtgcccaagtggtcattagagtcctttgaaagagctatttcagtgcatagggagatgttgaagatacagaagagagaaaagacaaggaagcaaggttctggaggaagcagaagatgtgggatcaagagcacaggtctggatcccacaagggctgtggtagacgcgcctttgcctgagttcttgttctgcatccaggatgaatgaggtatgcagacaagtgaagtgtgaagaataagaagaagacgaagagttttatttagtgttagaacagctcagaggagtgggtagctcctctctgtagacaggtcgtcctgttgagtgttcagctctcagcagataggagaccctggagagggtggctcctctctgcaggcaagtcgttcggacatctctgcaaatctctgaagctctcagcagagacagtagctcctctctgccagcaggtcatctctgaagctctcagtggagagggtactcctctctgcagctggttgtcccacctctccagagatcagcagagagggtactcctctctgcatctggtcatcccagtgtctctctgccctattcatcctctggctgtcctctgccctgttctggctgagcccagggctcagctgattgatccatgggtggccatgggtgggccgggaagaggcaccatgagcccctactccagtcagcgagactggcagcccagtccccagccttcaggccctccctggtctgagggtggagccttactgtggacgccactcctttccacccaggactctgtttgcctctcactgccattcattgccctggggctcagccccaaccccgctctgagattggagcaggtgctgagagtagagagagaccaggcagacaaccctgagcctgcagaaatgggggtggggtggggagagagttcatcctggggcccccaagggtgcaggctgcagagagacccagttcctgtgaggaaagctgcagctgcgcctgggagctcccaccccaccaactcagaagaggcagggctccggcttgtccccggctcctgcctggctcatggagcgggaggcccaggtttgcagccgcaggtccagccactgcaactgcaccccggaaggcagatcctgcctgttcgtggctcccccaagagcacatggaggctgagatccactgctgcagtttggaaggctgtagccccaccaggaggtcagggctcctgcccattctgtagagcaggaggctggggtctacagctgcattgggcagctgcagcgggcacccaggtagctccggtcccaactcagaagggggggggctcccgccagctccagggagtgtgcagccccagctgcgcagctggcgtgatggcggcagccactgccatcagtagttatacacgtacttgtgtgattttcctctagtcatacacagcctgggataggagaggaaagagcaggttaaagtttggttgtgagagaaaagatggaaacagaataggagagaggagagtgaagagaagttatcactcaggggttctatgctggttaaggaaagtaatttaaggtctcaatgaaattgaagaattgatgtcctaggagtaagcaagtgagagagttagaaggataggaaggtgtgatcagagggtaggatattcaagttcaaagtttcagaaatggagcagttccaattaccagcaaagtccgggatgtggttacagttgaagcagaaaagagaaggtcgtcccaattaaacaaagccagaaactgtaagaccaggggcttgaatgggttaatgaccattgaaagcccccaaagatggcaggaggcttgagagagagagagggagaaattaggatgtgttccacagtctgtaatgaatatggaagaatgaccaggaggtttttacatggcattgaccacctacttgaagatacaaacctcaaaaaaagagggcttttacatgaggagtgatttttttttttgaaacagcaatggagaactagaaagatacttgatactgtcaagtatctttacttgatacttactgtaaggaggagtggagttcttagatgagatccattggtgcacttgttacttcattcattcaacaaataattatagattggggactgtagagccaggtctacctggggacagttctagtttatgcttgtttttctgacataattgttaaaaatgccccctgttattctcaaaaggttccagcttggataataaattatagagcatttatggcctggttgagaaaaaagtctctgtggctccttattctgttttccatcatatttgatatcctgtcatttgcatgtttgggtatgggcattcatcctgttgggaatccatcaaattctactttcatccagcctcatttctccagttgttgagaaagacagcagaaaagacctgcctggcactcagatatgctctgcttataggttttccctaagttggtaagcccataaatagagaaaatgaagttagcctgtcacggttaacacttggtgagctctgctttgttttatttctttgcaaaaataatctgtttttaaaccagtccattaacaatacatttggaaatatggacctggattaacagcaaacactatggtcaatagttttcagaatcattctttttccattttcttgaaagtcaaaattgcaatgctcctccacaaaaaacttttagcttccccctgcttctgaccttgtgatatacttaatgcttgcaaacccacaatttagcacttaattgatcttgaataacttccatatttttctttcttgtctttgaaactttgcacatgttattcactttgctaggaatatccttccttccccttcatcactctcttttttgcctacttgtccttcagtccctaggttgaccatcatctcctttcaggagccttttcagcccactgaaggcataaaagtgtccccttctctatgttcctatagtagtattctatggatcagtccatgatcacccttatcccttatgtctgtaattgtgtgtttacttgtctgcgtctctcaccagactgtgaatgcgacaaaaccagggactgtgtcttggttacagttgtatccccagtatcttgtacaatgccagacacagagcaggtaccctgtaaatatatatgttgaatgaatgtgtgatccaaatttgtaacccaagtggtttaagacattgttttgcaaccatgaacatacaaaggggatcacttgtgctggagctatttttccccactgacacagagatatcctttgagggagcaaattatcatgccttatttatatttctcatagcctcacatagtatggaatacatagaagtatctcaaaaagtactttttgatttataaataatgctagagcattattttgactgcatgtgatttgatactgtttccatttaattcagataaagagttgaagagcccatttttatcttgctctgatggcccagcctttcttacaggcatttctcccttttgtttatcactcatttcaggatctctccacttccggattcctggatatggggatgggagattgcatttggcttgggtgtctctttgtcccaattctcctcagtcctggacccacacagatggcaccagcaaacaattgtttggggatgagcgtgtggtcatggcctaaaagcccaggtcccatagtaatttactggacaaatgtctcttctttctgagccatggtgtctttatctgtcaaggagatagttcaattaggtgattctttagttctgaaatttatctgattctctcctttgtaggcttatttctaacaccatacaatatgctgctgtccctggagcctccaacttatatcaaattctgtcaaggctcagattggaatcatagcaaatagatccctgggaagcatcccaatgtatgaattattaatgttcccaccacacagtctccatgcgaatatttacttatatcactgggtatctaatcctgacaacaaatcatcatttgaatcgtttactgatgttttctcttcccctcagtgattctgcacgtgtcttcctttcaccttgagaactgtgcaattctttcttcccctgtgagactctgacactgaacaacaaaaagaatgtcaacatctgaatcctaccttcaatgtttttccctattctcttagaaattgttgcatttcccccctttattctcaatccctctccatcccagaccccttcaagtcattctaacatccaggattgtgtcttttgccctccctactccatagctctagcagctatagtcacagagctgctcaatgaggttcttttttatttgtattttaaaataatttttattgtgtatatttgaggtttacaacatgatgttatgggatatatatagatagtaaaatggttaccatattgaaaccaactaacagatctaccatcatatatagttactttttgtgactagggcagctaaaatctagttgtttaacaaaagttcctaatagaatacaattttattaactttagtcttcatgttataggttagatctctagacttgttcatccttcatatctgctactttgtaacctcttacctacatctctccatttccttttccccccaacacttgcccatagtaaccactatttcattctctacctctgtgtatttgagctcttttaaaaagattctgcatataagtgagatcatgcaatatttctctttccgtgtctactttacttcacttagcataatgttatccaggtccatccctgttgtggcaaatggaaggatctccttttttgtgtctgaatagtattccattgtgtacatataacacattttgtttattcattcatccactgatggacatgtaggttgtttccatatcttggctattgtgaataatgctgcaatgaatatgggagtacagacatctctttgagctactgatttcaattcttttgaatgaacacccagaagtgggaatgctggatcatatgggatttctatttttaattttttgaggaacctccatactgtttttccataatggctataccaatccacattcccaccaagagtgcatgagggtttcctcttattcacatccctgctgatatttattatttcaatgaagatcttaatatgctcacagtcctagttatttcccagaggggaaaaaaaacctttccagatatctcagttctgtgatatggggcttgatcagttgctgctgcatccttcattttctctctggccttggctatccagtattccactccctttacctctccatatgtacctcttatctcccttccttaccccttccttctccctttttcatttcccacaacagttgctgcaggcttggtttcagccagcacttttctctgcctacaggttgaagaagccctttattccctcagaaatcctctgagctaactgtcctttaccacttccattgggagtaggtgcaaccacattgatttaattaaagatacaataaagtcaaactgcagaaaacacttagaatgatacttctctgccttgatacaaaccactgtctgtattgacttgcaaactggaaaattttggagggatcatgtgtatgcttcatttcttaatcatgataggattaagggttgcccatttcaattgatgtatgcctttctgtaagcaggagtatcctagccacctcagtgggggctgtggcatgataagctcaattccaactatgtggagggacctgagatgagttgaatgtcattgagtggtatgtcagtgaggtactggcatgtcagacagaagtgcctttaggaaatacagtctggaccagagccatgataaaggctcctgtctgctctatttgtctgtccatgaaaaccaaccaacaagtgttactgaaacacattcactcaaatgacattacaaatgttgacgacagatagccagctactttgtcaaaaaaaacaaggcaacagaaatgaaaggtaagttgagtagtaaaggggtaggataagaggagatcttgattttgacaactaatactaggacaaatcaaaggtctgttgctggaaggatagataattctcatggggcctccagaatattctttcattccttaagttgggtccctgcggcccagaaatagaaagttccatgcctctcctcccctagactgtgctttacttcttaaccaagagaaagcagggatctaaacaagttcagacttctctacccagaagtccttgctgatggtggttagcctagtcagactcccggtttcccagtctgagactattcctctctgaggctcaacatccctattctaacccttttctgtccccaccacattgagagcatccttaaaccacacccacccaggaaagctggagatggctaccagtttgccaattctttccattctggcaatggagataggagaggcctccttttgtgtgattatccctgtgtgctgctgcagcttaactgtggttcctgaaaatcataattatatcctgagattattaataatagtgttaaagacagatacctaaccatgatccttaaaggggacacccttatcactagttaactctctctggcttccctctttggcatgatactcatcccaggtagtaaatagggcaaattgaagagaaatttaaggctctagcacagataattgtgcatttctctaggataggattgggagttagtaatgggatatctccaaaaagattgacagtgctcttgttatactcagagacagggatgaggaaatagtttgtggcttctatacccctacgctgccacacatctacctctctcaccttgaaataaatcagggaaagaaaagaggcagtaagaaatgctgatttcttctgctgaccccagatctcatttcctactctctatcccaccaaccccaggcagtcaccattgcaggaacagtttgtgttaatggccaggtagaagtaggaaggcagtctcctagctaactgggcctaacataccggatgcagcctagtgtaaatgatttaagagacagatgactcgtgtctgaattctggctccatcattttctttgtggtgtgatttagggcaaattactcaattttcttgtgtctcagtttcattatctgtaaaataatataattgtagactctacctcattggaggtgttaagaagattaaacaacttaataaatgtaatacccaaagaaacatgcttgacacataataatctctatgtaagggtttgctacttgtattcatggaaagagcactgaaactaaagtcgaaattatcttcaccatttgtaagtcacttcaccttcctgtctttaatattattaccataagatggaaggaaatactcacatgattcctttgggaattaaatgaaataacacacagaaaacatctagcacttagcaagcatgcaatgtctggggataaagaataaataaactcttttttaattcccccatctattactacttactaagtatctatactttcagctctggcaaatcccatgcccttaggcctaaagatcctttctctaacatgctttcactaagaattctaaaatcaagtgatccctgccaactgtattctatttccattatttatttaggtaatggtattattactgccatttgttatgcatccacttattgaaatggttctgcagtggctgctaaatgggactatgacaccttctctgagaaaccttcctcaacacaccccctacccaccacaccttacccattcaattcttttctatatgctcccacaacttgctatgcatacttttaccactattatagtttgttgagtgaatgaatgatgaaagaaagacagaaagacaaaaagaagcttatctcagattccagaatatgcacacatcaccctgccactgatgactaatgaaattgatgatcaagccacactactttgcctaatttcatccataaacatgattcatgtttgtttctgtttgatttccaaggtgaaattgtgaattaagttggaagctgattcttattaaatagatatttatgatacctattccttgccaaacactatgctactaggtacactggaactatagagataaataagacacagttgttcccctcaattagctcagaatcaaactggggagctgagagaaattcgtgaagagaagcctgacgccagtcagtggagtggagtgggaaagagtatggtcctggggatcacatggcctggattagaaccttgtgtccttctttcatttactagctcatatggtttggatctgtgtccccacccaaatctcatgtcgaaatgtaatccccaatgctggaagtggggcctggcgggaggtgatttgataatgggtgcagtttctaatggtttagcaccgtcctcctagagctcttctcatgacagaggtctcatgagatctggttgtttgaaagtgtgtagcacctcctccctcttcctctcttcctcctgctctggccatgtgaagtgctcactccaccttccccttctaccatgattgtaagtttcctgaggcctcctcaaaagccgagcagatggccagcatcatgcttcctgtacagcctgtggaactgtgagccaattaaatctcctttttgtataaattacccaggctcagatatttctttatagcagtggaagaacggactaatatgctatccatgaataagtcacttagccttgctgagcctcagtttccttatctacaaaatgaggctgataataaaagtacttggagctggtcttgttgggaagattaaagttccatccagtctttctattatagaaggcactgttttaaggatattatgtgaatgaatcttttcaatcctcataatgaccttatcatgaaggtgctattatgttttttataagtgaaggaacagagagggtaagtaacttaatgaacgtcacacagatagtaaatgataggcatgatttgggcccaagcaggtttttttaaaatttggaaactaaggggaaaggaagcaacatggcaatatattgaaatagagaagcttaaaaaccatggatgtttactcttaagtttatgaatactttgttttgtctgatataactgactaccctgccccttagctaaatgaataataattatggtttattgaacatcaaggttctgtgagttggatactgttttaactcatttataaatattttttaaatcacagaaaccctaggaagtatgtactattatccccattttactgaggaggaaattgagaaacagagagtgaattcattttttaaggctcatgtggtaaaactgaaatttgaatagagtagcctggttccagatactgttaacttagccataacacaaggtagttaatgacagaggggctgggctttggggataccttacctttaaaaaaacaaaagaatatacaataaaattaacctgaatgatggcaaagctggtttcttattttatatgattgttctggttttgtagttcattttccttccctgactacatgtctgacatttccttgtccacatacctgggagcattttagtatgtgcctcacatgtctgaacagacttataagagactagcatgtgggagcgggtcatctttaaaggagattggaaggtgcaaaaaaatcaattcacaataccaaagcaggcccctgcctgacacctcttccatacccacacgttggagccattgtaaatgagcctggtaagttgaaggctttgaagggtgtatattgtggtgtttggttctttccctatgtaacagcctgtcagttctataagggcagtctggcaatgctcagttgatgtcttatctttacaagaataaaggaaaatacatccactgccttgttgccacctactccttttgttggaataatttggaataatacctggggtactttaaggttcattttcacccaagaacctcaaagtctggctaactgcattctatagtcattattctattttgtttaagaagcttgaaagggaatacagtccatggaagagtgaacaaacaaacaaaactaggtttgttagctagtcacctcagaaaagctgaaaaattacttttagtccactttgtgtttggtctgtgaggtttgaaccacactcagggccctgcgacactgattagatgaattctagaggcccttctctccatgatgtgaattataaaccttgccataaagttgtgaattggttccatcgtttgtttccagcatataattttggttgtaaagtccactaccattaagattcatagggcagaagccatcgttctttaactatattaagaagtacatctctgttctatttctttaatattctgatttgcccatctgtgggaaaaacaatattcttattcatgtaggaacactcagggattatttctgaagcaatcattgcagctccattcccctctccccatgacttgcagtatttctgggagaagaaaagaaaaaggacagggaagcactggtcttgaaaagtaaatacgtaacttcagaagcatttacctaaatgaggctcagtccatgcattttggaaaccactgaatctcttctggagacaagagaaaaacatactcccttacctcgaggagtttatagtagttgagaagatcaaactaatccatatgagaacaactttaaagtcaatgttaggtaattctgggaggaagataatataagctgagacatccttcacacccaaacttgagagactctctgagaaacctcaagatgtgttcaccattaatataatctaagttctaaagaaacgtcaatacctatataaggtgatggatatgttaattagctggattgtggcaatcatttcacaatatatatgtatgtcaaaacatattgtacaccttcaatatatacgatttttatttgtcaattatatcccataaagccagaaaaaaagaacctccaataacttgtaaatctcccaacatttactcctcatacaaattgcttcagatatctacccacaaattttccaatgatcttcatttttcaatagtctttcttattatcctagaacatacaaatatttgttgagtagcaatcattttccaggcgctgttctaggccttgaggacagagcagtgaacaaaacagatcatcatccttgttcttatgaagctcatattccattggggctgtgttaataatccttaccatcactaccacatagcagcactttgtgcaagtgtgcatgccacaaacatctgctcaaagaaaagacattagagcagaaacttgaatgatgtgaaggggtaagctggtgggagagttttctaggcagaatgaagagcaagtgccaaagcccctgcacaggagtgttcaaagagcaggttagtggagcagcacggaggctagtatggctagaagcacaaaggagcaaggagattggattcatatttctattgagcacctgttcattgtgctaagcatcaggaatatgatagaaagcaaaacaaatccagtccttgctcccctggagcttatagtctaataagagagacagtgtattagtctgttctcacactgctataaagaaatacctgagactgggtaatttataaataaaagagatttaattgcctcatggctctgcaggctgtacaggaagcatgatgctggcacctgcttggcttctcaggaaacttacaatcatggcagaaggtgaaagggaagcaggcaagtcttatatggctggagcaggaggaagagagaggtagggaggtgctacctcaaccagatctcttgagaactcactcactatacagtaccaagggaggatggtgctaagccattgatgagaactccgcccctatgatccaatcacctcccgtcaggtcccacctccaacactgaagattacaatttaacatgagatttgatggggggcaacacaaatccaaaccatatcagagagatatcaactaatcaaacaggcagatctaaaagtccaactttgaaaagtgctggaaaggaaaacttccacgtgctgtgagagaataatatgagggcctaatttagactggcagatcaaggaaggtttctcaggaggaattgctaggtagtagaaatctgaagaatgaaaaggagttaagtaggtgaagcctgaagaataaaaaaaacattccaggctgagggagcagggtattccaagttcttttggctgtaggaaacacgggaaggaggaaggactgaaagaaggctagcatggctgagtgtagagagtagatggtatatgctttgaggtgtgattggagatacagtaggagacaaactatgaaaggccatgttaagaggtttggtttaaacactgcatgttctcactcataggtgggaattgaacaatgagaacacttggacacaggagggggaacatcacacacccagacctgttgtggggtagggggaggggagagggatagcattaggagatatacctaatgtaaatgacaagttaatgggtgcagcacaccaacatggcacatgtatacatatgtaacaaaactgcacgttgtgcacatgtaccataaaacttacagtataatttaaaaaagaggtttggttttctaaaagcaatgggaagccactgaggagtttaaatagtgcatgtaacacaatcggattgactttctgtaaaggtcattctgactgtggagtggagtggattgatagaaagtggcaaatatacatgtggaaggatcttgtggtagcccaggtgagagatgtttgtgaactggactatggaggtaggagtacaggctagcgtggctggagagaagtggatatgtttgtggtgtagaactcacaagatttactgatgggttgtatgtggaaatgaaggggaagaaggtgtcaaggaaaattaaccagtttttttttttttttacctggtatagatgggtagatggtggtatcattcactgagattaggtacaatgaaagggtagaccataatttgaagtggaaggcaatgcgttccatacacacatatgcaaatatatatatgtatgtgtgtgtgtgtgtgtgtgtgtgtgtgtgtgtgtgtgtgtgtgtatggctgtgcattgatctgtgctcaagttgattgagagtattaacatgggagaccatataaattcaggttccttgtgtacatctgtgtcttgctgtgaagttctagaccctcagacatctctataatctgactctattcaacattttccatataagtcattcactccagcaatgtctcctaaatacttcctaggaaattcctgttttaatgccctagctcctgctgtttcacttgcccaggatgctttcttatctcatctgtaaaactcctcccagattctttaatacagagggctctttccatctgaattataatggaatttattggctgcagcatcatctgacattcgtcaatcacaaacaggtcatagctaatttacaattggtctgagctgcaaagttcatttgtatttcaggtgtctgaagtacagaagccattttttcatgtaaaatcttttataaatggttgttaggtttcaaggctagtccataaaaccaatttactctataatgtagctaaagtatggggacatttgcgatgcagaagagtagaaagtaatattcttaaatgtagaagagaaaacaaaattgaacaagaagttcttttatgtatttgaaaagctagtgcttgagaaaaatcaggttaaattcaagaggtaaattgagaatttcatggaaattctgaagaggacttctggaaagtttcaaggcaattagagcctgaagatgctaattctttagtatgtttaacttctcttcaaaacttttaaaaaagttatcctggtctaggtgtgtttttacactacattgtatgtgtaccagctatgcttagggttgctttattttttcagtttggatttttttcatggctcacaacaaaggcagcaaatgcatgtagtttttttatccaaggggttataaaatttctttaatctggaaaacacaattatgtgtattctggctcagattctttctatctgcccatggtccttctctgtgtttctgtctctctctctctctctctgactactcatgggcagtatcatttacccttggttttacagtcccatagcaagctgcttcttaggagcaagtagctaaatataaatgactagagtgaaaatttagttccatgcccctactttctggcttgcgttcacactgactaacttctcttacctggcatggcctacagccaatggattgggacactcagggccttcctttggggctagagactatagcacaaactgaggggcctattctacaaggtggagttaacattaacttcttaattcatcctgacccctaaaggtcagcctcagagagacgaaggatgtttaggtgggagctaaagcagacagggggaatcttgggggtgggagcagctctctgatgttgatctagagatgcccatagggtaatttaaatcagttgctcaggagtcagacagagcttgtagaaatgaaattataggcatcactcacaaatggatccctctttcacaaccattttaaaattttgtttactgccgtttccaatttagttaataaaatgtaggttctgtgagagcagacacttgattttgctcactgctatatccctagcacctataatagggcatgacatagagtaggaatgaaataaatatgttttcaataaatcaatgaatgaatagtatttttcatttaaaaccagacctttttcttacatttcttctggtgactcaaggccttttctatcctattctgaatattgtagcttccgcagatgttgtctacagaatcatctagaacaaaagatctttacaagtatccaacaactgaagtaactatacccgtattggtcatgtttaaagccatcatcattgatttaagaaaccacatcttctctaagagcactcatctctcagtcacctccctactagcctttctaggtgtcactgagacaatgtcccatacttccacagatcttgatcttcatagacagatatttgcctgaacaagaacacatttagatattaatttcatttttgtaatctattctaaagtgacaagtgactgttttcaaactacagttgattgaataagaagtagagcacagtactttttgccatccatagtctattttcttgcaccattaactcatgaacagatcaatatctacactatcaaggtatgaaacgagaacctaccaattatatcattcatttgtgtgtttctttgactgtgtctttttagcagctagattttagcaaaactttttccaaaactaaaaatttggggctgatggtctgtcctgaaattgttaaagcatttcttcttctctcattctgctatttcataatgaccttagtcttatttttaatgttgaacgtggctttgattttgtttatttataattcagaggtaagcaataaatgtactgttcaaagagaaatacttataatccagttatggatgtcggtttatattacatttatacacacttaggaggagactatcaccaaagttgctggttgggtgaatttgaataagttgatgcacatttaatcaacagattgaatgaaaaaggattgccacttgctaattgaatggaataacagaggaggaaaatttcaaaacatgcctctcttttgccaaaggagtaaatctgaagaaagctctttttctttccttttttaggctgaagtagcaatttctaacccttattgtttttgtggcaagtgacaagaaaatgcatttttgtgtccaattcctctttttcattgttttgctgccataaaactgctgggtgccaactaggatgtcttctcaccaagagaagaagggattcttgtctgatagataatatcagtggggcagctgttattttgatttgcttatttggaaagctgaagtttacctgtatgcctcttgccaagcaaagaaattcagtgaaaggaagatgagaactgagaagagacagagttttgttaagatacttaattcagcctgggcaacgtagggataccttgtctctacagaaaacaaaattatccgggcatggtggcacacacctacggtcccagcagtcccagctacttgagaggctgaggtgagaagatcgcttgggaataggaggttgcggctctgcactccagcctgggtgacagagtgagactcttgtctaaaaaatagatacttaattgtctctgcaccagatttcttctaatagcatggtttcaactgttcccagaaatatccagctattctctgcccatgactccatatcttccagcctcttttagtaaccatgttttaataatattatcaaattttgctccctaattccctgtattatatccaaatttccaaatagtttggggtgccttttattcaacctctaacagcagtctgaactcatatgagtcagaaggatactttaccaatactgcactggttccataaaaagcatgcagttctcattagtgcagtcaacagagtcagcaaagggattatgtggacaatcatctatcaggctaaccacccaagcctctgaccaagactatatatctaaaatgccccagaaatgctcctatttttttaattctaaaaacgtttatttttctaattataaaggtagttgcttatcattataagagaaaaaaggttggaaaatatgaaataaacaaaaccaaaagcgcaaagaagataatacaagttactttagcttaacacattatcttacttttggtctttcctgtgtgcaaggacctgtttcatttactgctacaaaatttagtggcttagaacaatagattattatttctcatgcttctgtgtgttgacttggcagttttgtttcatgtgctgtcagttgtgatgctgggataactgaacagtccaaaatgatctcattcacatggctaataagttggtgctggctgttggctgattgctcagctgggattgttgtctaagggcttggttttccttcatgtgggcctcttcacatggcttcttgggtttcctcccagcaacacagctgggttcaagaaggtgtgtactaagtggtgaaagcagaaatttcagatattttaagactcaacttcagaagttacaaagcatcatttctgccacattctattggtgaaagttaatcacagggatagcccaaagtcaatgtgggaaggtgtgaacactagcaagtatggttcacagtggggggttatattgtagactagcttccacagagctctttccttcccttcttcccttccctctttccttctcttctcttttttctcttccctttacccttttcttttcttttcttttgagtttcttttcttttcttttcttgtctttgagttttgctcttgttgcccaggctggagtgcactggcatgatctcgtcacagagccctttcaatccccctgccccagccaccttgtccctctgtagccacaatggggcagatttgtgaaatgtggatggtgacggtggtgtgtatatgtaaggcagtcaggttgaggggatcagtttgatacacaactgagctccccaatgctgaatgactccttatgtctggtttttgttctatttctaagtaaatgaccatcaaaaagtgtgatgaaaatcagggtctcagcttaaatatcacttcctcaaaaaagtcttgactgtacactctgttcccattttaactagattccccccattattttcaccttcgtttatcatagttttcataatttctagcttatgattttttatgtattcatgtaattgtttgttttatggtgttttgttcacaattccatcagccacatgaaagcagggaattagtgtatattgttcagataagcacatagcacagagcataatagagaataggtgcttgctgaatatttgttgaatgaatgggtgactgaaaggaaatctgaatgtctgtcctcatcactctttcactcacacacatgcaactataataatcagtcctggcttgtaaataggaagctcttagtaactatcttcctcaaatctgttggagataaagaaagtgatgcagggaaatttcaatcaaagtcctattgtgacatctagtttctataagagaaggctattttcaggttctttccatactgaaaattgcagtttggttttcataccatttcataccacttccaatgaccccaaattgccacctaaatgtctcatgtttacatttactataaccagtcccatttcagcatttgagattcaatcctattagctttcaattctctgccattgataccatcatgtacccagttatccccaatcatctttgccactttgctcatctcctcttttctatacacagtcattttccaaggcctattctgtcttctattttctgtcttctattctcagcttccataccactacattacttcatatccctaccacctcttttctgggtaaatctccttcctccactcttgtcagctccaatccattctccacactgtctgtaagaatgaactttctaaaatgtaaatctaaccatgttacttactgtcagtattagtccactgctaggttgaatatttatcgaatgaatgggtgactgaaaggaaatctgaatgtctgtccttatggctgctaccataggttgtggctctcttattttatatacagaaaaaatggacagcctcattcattcattttttaagttcaacaaacattcattgagtacttatcatgtgccagacactaagaaaacaaaaatttcatgatcaggtttccatctttgaggaactgacagtctcattggagcatataatgattctgttattgcaatctattagtgctattagaggcattttattaaaatagagggcaaagcaacaaactgtttgggggattggaacatggggaagagttggggtggagaagttgcaggaatggcagaataaatgaactaagtcatgaaagaagagaagttcaaccaatggccaaggagaagaaatgtataaaacagaggaagaagagcacttgtaaaggcatgaggatatgagaaagtaaggcactcaatatggctagaacttaagagtgtacaggaaaaagagggggaagatgtggcctaaacaaaggccataattctataagagctatatactacctactatgtagttctgtatttgaattgaagggttttaagtaggatagtgatatagtttagatccgcgttcccactccccgcccaaatttcatatcaattgtaatccccaatgttggaggtagggctttgggggaggtgatttgatcatgggggtggctacttatgaatggtttagcaccatctcccttggtgctgtgttgaaatagtgagtgatttcttgtgagatctggttgtttaacagtatgtagcacctcccctctctctcttttcctcctgcgttagccatgtgagatgcctcgctccccctttgccttccatcatgattggaagcatcctgaagcccccccagaagcagaagctgctatacttcctgtatactctgtagaaccatgagctaattaaacttcttttctttataaattattcagtcttaggtatttctttatagcaatgagagaatggactaatgcagacagtaacatggttacatttacattttagaaagtttactcttacagacaatgtggagaatggattggagatggcaagagtagagagaggagatttacccagaaaagaggtgatgggaatctgaagtaatgtagtggtttggaagcttagaatataggacagagtggaagagtgacatgaaggagagtaccggaaacagagagaccagataatattagggatgaaataggattggtcaattttgtgactctagcaaaagtgctatcaggtagtattgagactgaaaccagatttcagtgggggaagtgaggaagtagagacagaataggcaaatatttacagacatttggaataaagagtaacaggatgatgtttatgaggaacaacatgggtgaagttgactcttgttaatttaatattgttctttagcagatgagagcttagggtgtatatttactgagaggaaaaagtccacgggaacagataagttgactttacaggagaaagacgggatagttgctggagagggaccctaaggagatagaaggcgaagataaaatggaactcaagaggagagtggtgcagtcgttgctcactctcagactacagtagtgatgagggtgatcttgaaatcaaataggcctagattcaaatctcagcgctgccatttgctatctgggtaaacctgacaagcacttaatcactccaaatatccattttctcagttacaaattgaggataactaaacctttctcacaatgtagttgtaaggattacatgaaagagtaaatgataaaaatggtagttattactaccaatgagaacaggatgggggtaagctagagataaatttggcagtagaaggccaagaatggaaagatattccaaccgaagtcctctaaatttctcaaaaaagcttagctgataaaaattcaagcaatgggggtggttaaagggttgaaggaaagtgttaaaaacttggaatctgctaagaggaaggagagagtgaggtttgagaaaaaaaagattgctgatcagcatcaagggccttgactttattcctgtccttcagtctcttcccctcgaatccatcttgcacagtagcacttgattaatattctcaaaaggatacattcatcatgtcactccaatacatgtctactaaataaagttcatgcttctctgtttggcatttcacgccatctgcattcagatgtcttcctgctatggaagcttctgcaagcccacaaaccagctagaatatttacagttccccatatttgtcttttgtttccaattctgaaccttgtttgtgttattccctgtactctcaactgaagttcatttcaacagtttatactgtgcaagcttcagggtcctgaagagctgggttccaatatgaactcttccactaaccagccatatgatcttaggcaagggattttgcttctctgtgccttagtttccttgtgtatacaatagggtgtcttagtccattttgtactggtataacataatacttgagactagggaatttataatgaacagaaatttatttcctcacagttctggaggctgggaagtccaagaccaaggagctggcatcttatgagaaccttctcgctgcctcatcccatggtggaaggtggaagaggaaaagagggcgagagagagagaggcaaaagggggttgtactcatccttttgtaacaaatccactaccacggtagtggcattaatctatttatgaaggcagtaccctcatggcctaatcatctctgaaaggtcccatccgccaataccatcacaatggcaattaaatttcaacatgagtttttgaggggacaaaccatatccaaaccatagtatagagataataatagaaatcacgtagtggtattgacaggattgccttaacagatgtaaaaaaaaaagagaaagcaatagtagatcaccctgcacataacggaaactcagtaagtggtaactataactcatttgtttactaaacatttacagaatactggttatatgccaggcactgtgctaggcctcatggatatggagacgaacactaactacacttgaaatcccgcatgcctaatttagtatagggacatcatcatggcctcaaggaaaagttagtattggtaatgagtcttgaagaacttgtagatattgccaagcagtcaagagatttaagtgaaatactctaactttttaaaaaacttatgaaaatacttggaaacaatcaaaagcctggttcatttgctgagtaacacaaagagattgggcattggttgtaattgttattataagcaacagaaacttaatctgaagctgaaaaggtatttattaaaagtgtattgggtagcttcgaatgcacgatgggaagggatagagaaggacaggaattggtaagagatgcagccagataagtggtcagggaccaggtcatgaagagctttataggacataagaaatttgaacactattctattggtgataaggacctgtcacagggttttgttgttgttgttgtttgtttttcaaagacagtgacatcatttgtgtgttatagatacatcattctggctgttgtgtaaagaatggggaggtgatgtgtttagactagaacatgaagaccattatgtcaaggtcagacaagatgattgctgaattaaggcagagagagtaagactagagacacaaggatgaattacagagatcttcggaggataaaatcaacaggacttagtgactttattggatttaaggaaaataagggattgcaattaaggctaatttacaggcttttgtcttgggggactaggtggacactggtgtagttcattgagactgataatatagaagaaggagcagatttggaggaaggtagacgctaaggccagttttgcagatgttgaatttgaagagtcaataaacagctgtgtgaagactttcaacaggattttggatgcacaagtatcaagttcgaagcaaggtaatatagatgtaaatttgggagacactttaatatcagcagtacttgaaaccaaaagggtgaatttgatcacctagggaaagtttatagagtaagtgcaataaagacagaaatctgagaaaactcaacactgcaggagcaggtagagaaagaagattctgaaagacagaatatcaaagcatagtttgagaagtaggaggagactcaggagataatggcatcacaaaaaccaagatgggagagagtttcaaaggaggattggtccacaatgtcaaactctgctaagagtttcagatgaaatcaggactgcaaagcccgcattgatttgacaggcagcaggtcatgaggaaatttatctgtggggaaaagtgaaggcagaagccagactgcaatagtttgaggagggaatgaaaagaggaagtgagaaactatgtgtaaacaacttattctataaaagtgactataaaaggaaagagagtatttccaacttccagaagagctaagcaagctcaagaaaatccccccaaaaagatctagtaagctgttcaaaattaacaaagtctctggagattgatcaaagggcttacaaaaagttgggaaacatttatttttaaaatgtacagaaacttgataagaacagagggaggccatggcatatgggctagggactgtagccatccccagcagttatgtcatgcagaaaaactgtttcagcaagcttggttgccaagtgacaattctcatcttccctgactcctggggtggaagaactatcttgtgtgcgtttggcagttggcaaacatcatcatatcccgttttccacagttctgttctatgtaaagcctatatagagttgtggaagcagcccggaaccgcctgttttccatccccaattcccactctgtagggaggattcagacagggtagctggtgaaaagaatagtcgacttttcccgcacatctctgtgttatgggaaagcagcttcattgtgttcacagtcaagtggtagctccaatcttgccaagatttccaaggtggaagacctattcctggtagaatcagtggccagtgaaagttgagatcacatcctctccagctctgagttgcagaagatctatactaagcagtgtcagcagctggaggtggcactagtgcacatgtgcacacacaaacacacattatctgctccagaggaaggatctgagtgaatatacagtgaacaacaagttccccatcccccatctccacacccctgcttctgatttgtgatgtgaagtttcttcccagaggcatgtccgagcaagcctaacaccaaggaacccaactacgattgggtgagactgtggagcaacttacgctgcagagcattgttgaaaacaacagagaaatcagctagaaattaatagaggctaacagttggtcataatgctattagaatcagatcagccagaagcttaagaataacatcaggtaaagagactgccaaacagagccaggttaaaccacagtcaagcctggcagtcaggaaaactgtgtgtaggcctaaggctgtaccctctgaggagcaacagaagttctgaattaaggggaaatacacttcactgaagtagtccagttgagtcatgaagatgcaattaagcaatcagaaaaaaatcctgagaggggatctagactggtttcaataaattatctaaaatatccatttaacaaaaattatgagacatgcaaagaaacaggaaagtatgaaccatatacagaaaaaaggcaaaagaaactgcatttgaggggacccacatattgacaaaagagacaaagacttcaaagcagctattataaatatcttcaaagaacaaatcaaaaccttgcttaaaaaattaaaagaaggtatgatgacaatatctcatgaaatggagaaatcaataaagaagaagaaattatacaaaagaaccaaatagaatttccagagttgaaaagtacaataaccaaaatgaaaaattcactagatggattcaacaatcgatttgagttgaaacaagaaagaatcaatgagcttgaagacagattaataaagattatgcaatatgaatggagaaaaaaaggatgaagaacaataaacagaggtgcagataaaccatgtgggacataattaagcacaccaacatatacataataggagaaccaggagaggagagagagagagaaatgaacagaaaagtatttaaagaaataatggctgaaaatttcttaactttgatgaaaaatattaatctacacatgcaagaagctcaatgaactccaataaagataaatgcaaagagagacacacgtggacacattacagttaaaatgttgaagtcaaagacaaagagaaaaatttaaaattagtgaaggataaatgactcattatgtacaaagaagacatagatgacttcatatcagtgacaatggagtccagaaagcagtggtgtgacatcttcaaagtactgagaaacaaaacaaaacaaaacaaaaccacaaaaagctgtcaaccaagtttttttttgtttttttttttgagatagagtcttgctctatagccaggctggagtgcagtggcacgatctcagctcactgcaatctccgcctcctgggttcaagcgattctcctgcctcagcctcccaagtagctgggactataagtgtatgccaccacacccagctaatttttgtatttttagtagagatggggtttcaccatgttgaccaggatggtctcgatcttttgacctcatgatccacccgcctcagcctcccaaagtgctgggattacaggcgtgagccactgcccccaactccaagaatcttgtagccagaatatctacctctcaaaaatgaaggggaaacaaagacattttcagatcaacaaaaccagagagaatttgttgttagaatactggatttataagaaatattgaagaaagttcttcaggctgaaaacaggtgataccagatagaaattcaaatccacaagaaaaaataagcactgataaaggtaattgtgcaggtaattataaataacagtatagccaatttaaaagtcaatcacataaaagatgtatgcatgtaattgtattttggacttaaatagaatgtaatccgtttgataataaaaggacaaagcttgcaggtaggaaaaaagctgatttggagtaagaaaatgacaccatatggtaatacgaatacaaaagaagaaacaaaaagaactcaaatagctaattaagaaggctactaaactgtttaaaaaatacttgtcctttcttctctcagcttctttcaaatacatacatttatataatgtaataattaaaacactgcattgttggttttaaaatatatataggtattatctatctacatatatataacaataatagcacagaacaggggcagatagagctgtataggaataatatttttatatcatactagaattcagctagtataaatatgaattagattctgataagttaagatgtatatggtaagccctagagaaatcactaaggatataactcaaaaaatatagtgaaaaaataattaaaggaattaaactgttacacgaggcatattcacttagtgcaaaacaaagcattaaaaaggaaacagaggaacagaaaagacatgagatatatagaaaaccaaaagcaaaatgacagatgtaagtccaatttatcaataataatattcaatgtttatggattaaacaattcaatcaaaaaagaaagattatcatattggttaaaaaacacaggctcactaaaagataatacctaataataagattataggaggcttcactttcctccacatctaaccacattaatagggttcctttataattatagtgaattgtagctgaaaaaaacttgcagactctatttaagaagtagttgctaggcaaacccaaagatatcagagaagataaaaataaggacactagaggaaactgaagttcacctatatctacaaaaaacattaaacagagcttagttcctagccagataaacataaaacctcaccctaaaggcatacttatctctctgttcctattacttgatacataatatctggttttcaacaaaaaattaccagaagcactaaagggcacacacataaaaatgcatcagaatgagactcagatatggcagagattttggaattaccagactgggaattcaaaatacctgtgaataaaatgctatgggctctaatggaaaaagtggacaacgtgcaaaaccacatgggtaatgtaagcagtgagaaggaaattttaagaaacaattgaaaacaaattctagaaagaaaaaacactgtaacagaaatgaagaatgccattgatgggctcattagtagactggacacggtaaaggaaaaatcagtgagcttgaaggtatgccaatagaagcttacaaaaccgcaaaagaaagaataaaaaaagacaactgggaacaattagaaaaggtaaaacataagtgtaatgggaatatcagaagagagaagaatagaagaaatatttaaaatagtaatagctgagaatttcctaaaattaatgacaaacaccaaagcacagattcaggaagcttggagccccaacaagctggataaataccaaaacatctacaggtaggcatatcatattcaaacctcacaaaatcaaagacaaagaaaactgtgaaagaagccagaggaaaagaaaagttgtgaaagaagccagaggaaaataaaaaaccttacctaccgaggagcaagtataagaattatatcattcttcctttcagaaaccatgcaagcaaaaagagagtgaagtataatatttaaattttgaaaagaaaaaaaaccccaccaacctagagttctgcatccttcaagagtgaaggagaaataaagactttcaaaaagcaattaaaattgtagggctttttcactagtagacctgttttgcaagaaatgttaatagctcctcacagagaaggaaagtgatatagatcagaaactcagatttacataaaggaagaatgttagagaaggaataaatgaaggtaaaataaaatcttttatttttcttattcctagttgatctaagagataacatgttgaaataataataacaatgtatttggtgattgtagtttatcaataagtgaaataaatgacaacaatgttatgagtgatgagggataatttggaattactgttataaaacatctgcattacctgtgaagtacgctattatttaaaagtggacttatagtaatcgtaaattatattaaattgtaaatgcatactgtacactctaaggaaattaataaaatattaataaaagaagtataatatgctaagaaaggagagaaaatgaaattataaaatatgtacaattaaaatcagagaagtcagaaaagaggggaagataaaaatgaacaaacaagtgcaacaaacataaaagagttacagacatgctagatattaatctaactatattgtaatcaccttaaatgtatatgctataactgcatcaattaaaagtcagaggctgtcagagtagattaaaaaacaagacccaactacatgttgtctaaatgaaacctttaaatataaataaatagattaaaagtaaaggggtaagataaagtaaagatacgccatgctaactataatcaaaaggaagctgggttagctatattagtttcacaaagcagacttcagagcaaggacatttatcaaggataaagaaaagtattatataatgataaagaggcatattctctaagaggatgtaacaatcctgaatgtatatgcatataaaggcagagcatcaaaatatgtgagacaaaaactaatagacctacaaggagaaacagatgaattcattattatagttggagaattcaccacccctcaatcagtaattgacagattcagttggcagaaaatcagtaaggatatagttgaactcaacagcaccatcaatcaactaaatttaattggcattcatagaatacttcatccaacaagagcagaatacatattattctcaagttgacatggaacaacaccaggagagaccacattctgagccataaaatatactttaacaaatttaaaagaccatgaataatacaaaatatacttaaagattacaatggaatcttaaactagaaataagtgatagaaaaatagctgaaaaattaaaaaaaattggagattaagcaacacacttctaaataatacacaagtcaaaagaagtcttaagagaaaccttaaaatattttaaactaaatgaaaatgaaaataaaaattatcaaaatttgtgggatgcagtaaaatcagcatttagagggaaatctatagcattgagtgcacagattatagaagaaaaaatataaaatcaataatctttgtttccactttaggaaactagagaaagaagaataatataagtctgaagcaagcagaataaaataaaaattagatcagtaatcaatgaaattgaaaacaggaaatcaatagaggaaagtaataaaatcaaaggctggttctttgaaaaggtcaacaaaattgatatatcactagccaggctaaccatgaaaagcaaatacggaggacataaaatactaatatcagaaatcaaagagagcccatgggtgttagagaggataataaaagaatattatgatcaattccatgcccacaaatatgataacctagataaaatggaccaatgcttgaaaaaaagaaaactaccaaaactcacacaaagagaaatagataatctgaataggtctatatccattacaggaattaagtcaataattcataacctcccaaaacagaaagtagtaggcccaggtggttttactgatgaattctaccaagcattcaaggaagaaatgataccaactctttataatctctttcagaaaatataaacagaagagaacatttcctaactcatcttatgaagtcagcattattttaataccgaaaccacataaagatattataagaaaaaaactgcagaccaacatccttatgaacatagataccaaaatcctcaacaaaatattagcaaatcaaatccaacaatgtataaaaagaattgtgtaccatgactaaatcaaatttattccaagtatacatggctggttaaacattcaaaattcaattaatataatctaccacatcagtaggctaaaaagtaaaaatcatctgatcgtacccattgatgcagaaaaaagcatttgatgaaatctaacacagattcataataaaaaccctcagcaagctaggaaaagagaggaactccctcaactttttaaaaatctacaaaaaaatctccagctaacattaacttaaaggtgagaaactggatgcttgctccgtaagactgggaacaaggcaaggatgctcctctcaccactcctattcaccattatactagaagtcctagctaatgcaataagacaagaaaaggaaataaaatgtatacagattgggaaggagaaaataaaactgtctttgtagataacataattgtctatgtagacaatccaaaagaatagacaaaaaactcttggaactaataagcaattataggaaagccacaggatataaggttaatatacaaaagtctatttctttcctatataatagcaatgaacaattagaatttgaaatagaaacgtaaccatttactctagcaccaaaaaatgaaatacttaggaataaagctaacaaaattcctacaggatctatatgaggaaaactacaaaactgattcaagaaatccaagaagacataaattcatgaggagatagtacatactcatggataggaatactcaatattgttatgatgtcaatttttcccaactataaaagtttggaaaataacttgctagaatttagcaatggttactgacaaagtgattctaacatttatatggaagggcaaaaaattcaagatagttaacacaatactgaagaacaaaaaaatcagaggactgacactacccaactttaaggcttactataaagctacaataatcaagacagcatggtactggtgaattgaatagataaactgaccaatggaacagaatagagaattactataatactatggtaatcaatatactgtggaagtgaaagcaacagaaagataacaacagtaatagaaataggaagtccatagatacacccacagaaatatggtcattgatttttgacaaaggtgcaaaagcagtttaatggagaaagtatagtcttcgacaaatggcactggaagaattagacattcatagacaaataaacggatgtttacttaaactttatataaaaattaactcaggtcatagatccaccataaaattttaaagatgaatcacagggggaatcttggtgatctgagattagatgaaaagttcctagacatgatatcaagagtgatatcagcaaaggaaaaaaaaagtagataaattggaatgcatcaaaataaaaactttcactctgtgaaagacactgttaaagacgagctatagactgggaaaatatatttgaaaataacatatccaacaaaggactcatatagcactgaatagtggcacttattccatgcctgactcatttggggcctctcaggtttcctgtttacctagcagaggaagataatagcactagttgaacaatatttttcattcaatggactttattatagccattctttcattcaacaaacatttcagtattgaccacaacacttacatgttaggcactgcaaaacatccaaatgtgaataagacattattccttcattcaagaagcttgcaacttagtacagataatggtacaaatagacaagtatctgtaatgcaaggcagaaagtgaagaacactctaaaggagataagatgataaagtagaaatctcagcttcctaacttctcatttgtttgactttagacaagttgtttaaccttatagaaccatactttcctcaaatttaaaatggaaataacactatttaccatacagtatcattgggataactgaatataataatgactatcatagtgcctgtgataatgttgaggtagtcactcaacaaagttagtttgccatggagaaaaatttcatggataaggagacatagagatggtgacattggagttagtcattggacaattagagagaacatagagaggcagaaatagaggcagtctcccccttgacatttaccccccccccaaaaataagccacctcctgtactcttctagctactgagcaaccctctcatttattattattattttttaagttttttttcgatacagagtctcactttgtcacccaggctggagtgcagtggtgcgatctcggctcactgcaacctctacctcccgggttcaagcgattctcctgcctcagcctctcaagtagctgggattacaggtatatgcatcaccatacccagctaatttttgtatttttagtagagacaggtttttgccatgttggtcaggctggtcttcaactcctgacctcaagtgatccacccgcctcggcctcccaaaatgctgggattacaggcataagccactgcacctgaccctcacttctttttgtttttgttttgttttttgacttttaactgttttatagagatataattcacatattgtaaaataacccattgaatgtatacaattcaatggtgttaaatatatgcggagagttgtacaatcatcactaaaatgtatatttaaaacattttaatcaccccaaaagataatgcctgaatttatgcttcaaaaagatggaatacacatatattttcatattcttccaattaagtacagattaaaaaccctgaacattatgtgggacagaaatttggaagtatctaaaaggtgcagaaaaaaaaggtaaaacagttagggaccttgaaacccaaggaataacaccatctcgctaaattcccacctccatccagaagtaacaaggagtcccttcctgccagatatcaacagacgctgaatggaaacctgaatttctacacccacctggaagtaataaggtggcaccatctttcacctacagagtggtgtcagaggaggccttctaaaacacgagatttaaataagatgtagactttcataataccccaaatgtccaagtttcaactgaaaatcactgacatgcaaaaaaaaaaaaaaaaggtgcagaaaaaaaaagataaaacagttagggaccttgaaatccaaggaataacaccatctcattaaattcccacctccacccagaagtaacaaggagtcccagactccttggaagtaataaggcggcaccatccttcacctgcagagtggtcagaggaggccttctaaaacacaagatttaaataagatgtagactttcataatacctcaaatgtccaagtttcaactgaaaatcactgacatgcaaaaaagccaagaagatttcaacttgaatgataaaaaccaatcagcagatgctaacacgttgacagatgttagaattatctgacaaagagtttaaagcaattatcataaaactgcttcaatgagcaatcataaccacactttaaaaaattacaaaaaatagaaattctcagcaaagaaatagaaaaatctcagcaagcaaatatataaaaagagccaaatggaaaatttagaagttaaaaacacaatagttaacttcaaaatatcaacaatgaactcaacagcagaatggagacgatagaggaaagaacttgaatacagaataatagaaatgaccaaatctgaataacagagaaaaaataagtgggaaaaaatagtgtgtcaggaacctatgagactgtaacaaaagacctaaactttatgttatttgagtttcagaaggaaaggagaaagaagagggagggactgagaaagtattcaaagaaataatgattgaaattttccaaaatttgacaaaagacataaacctaaaaattcaagaatcaaataactccaaacataataaacttaaagaaagccatgacaagacacatcacagtaaaatttctgaaaactaaaaacaaaaaaattctgaaagcagccaaagagaaacaacacattgcctataggggaaaaacaatttgaaagacaacacatttcttatcaaaaactatggtggccagaaggaagtgtgtgcaacatttttcaagagctggaaggaaagaactgtcaatcgcaaattacattttcaacaaaaatatccttcaggaatgaaggaaaacccaaacattctcagaagaaaaactaagtgaatttgtcactaccagatctacataacctaaaaaaattgttaaaggaaactcttggaatagaaagaaaatgaaaaaataggaatctttgactatctggagggaaaaaggccagtggaaaaagaaaattatatagggaaatacaatagattttgcttctcctcttgaattttccaaattatgattgatggttgaagaaaaaataacattgatattgttctcaatgtatatagaagaaatatttaagacaattatattataatgggagaagggcaaaagtacataaagggaggtaagttttctatgcttcactcaaactggtagactttttaaagatagatagatacagatgtataaatatataaaatacaatagatggtacaactaccaaaaatgtatacaaagatatatatccaaaaatataatatttaaataaaaatagaattctaaaaaatgttaacccataggaggaaaggaaacaaaaaacagaaaaatgaaaaacagagaacaacaaaaaataaaaaataaaatggcagtcataagccccaaatatatcaataattaaagcaaatgtaagtggcctctatacaacaattaaaagacagagatcaataaaatagattaaaataggctcaattacataccaacttcaagaaaatcacttcataatgatgtatatatgtgaaaagtaaaaggatggaaaaagatatactatgcaaatattaatcaaaaaagcaggagtgcctaaattaattttagatagagtagacttcagagcacagaaaataatgagggacagagacattacataatgataaaaggatcgatccatcaaggaggcatagaaattctaaatgcgtatgcaaaaacaacagagctccaagatatatgaagcaagaactgatagaactgaaaggggaattagataaatccacaattataattggagacttcaatatccttctcccaacaaacactttatttgtttttttaacttttattttaggtttagggatacttgtgaaggtttgttacatagtaaactcatgtcacagggttttgttgtacagattgtttcatcacccagaaattaagccaagtacccaatagttatcttttctgctcctctccctcctcccaccctctaccctcaagtagaccccagtctgttgtttccttcgtgttcataagttctcctcatttagctcccacttataagtgagaacatgtggtatttggttttctattcctgtgttagtttgctgaggatggtatttaaaaaaatactaaacatagagttatcatatgacccataactttcatttctgggcatttatcccaaagaaacaaaaacttatttccatgcaaacacctgtacacaattgttcttgccacctttatttgtaataaccaaagaaaattggaaatcattcaaatggccaatgggtgaatggtgaaacaaactgtggtacatcaataacatggaatactatacagtaataaaaagtaattaaccactgacacatgggacaacttggatgcatctcaagggcatttcactaggtcaaaaaaagagacactcttaaaagataacatactgtatgattccatttatataccactcttgaaataacaaaactatagagatgagaaacagattagtggttgccagggaacgaggatttggggtatagaagaagtaggtataatcataaagcggtaacatgagggagatctttgaagtgatggaatagttttgtatcttgattgaggtgtttacaagaatctacacatgtgattaaatgacatagaactatgcacacagtttgtggcaatgttaacgtcttggttttgatattgcaccataattatataacatgtaaacattagggaaaacagaatgaatgatacatgagacctcttggtactatgtttgcaacttcctgtgtatctgtagtggctttatatatatgtataaatttccatatgcgttagcagtcactccttatctgccaacctcctctccctctccccagctctaggcaaccattaatctacttcctgtttctgtagacttgactatttgggatatttcctatgaatggaatcataaaatatgtggtattttgtgactagttctttcatgtaacaatgtttttaaggtgtattcatgttgtaccagtaccagtagcagttcattcctgtttattgccaaatattattccattgtaggcataaacatttttttccattcaccagttgttggacatttgagttgtttctgctttttggctattataaataatgctgctatgaacattaatgtacatgtttttgtgtggacttaagctttcagttctcttaggtaaatatttagagtaggtttgctgggtcatatagtattccatgtctaacattttgaggaactgtcaaactgtttctcaaagtggctgaaccctttcacatttccaccagcaatgtattttttgtacttttgattatggacacctagtgtatgtgaggtggtatcttattgcgattctgctttgcatttccctaattactaatgatgctgagcatctttttatgtgtttactggccatttgcatatcttctttggaggaatcatatcattctccctatatcttcacatcacattccctccgtgcatgtctctgtgtccaaatttataaggacacgagtctcattggattagggaccaacctaatgacctcacttgattacttctgtgtagactctatctcaaaataaagtcacatcaagggtactgggggttaggacttcaacatccatttggacatgagagacataattcaacccattttaagtaacagttttgaagtaggcccagagtgttatgttctccataacaaaaggattcccttaagggaaactatttcaccagagccttatccagtatgggcaagggcaattagataactccaaccccttctattcttccagtctcacctaagaaagaagaaaagctcataagccctgtaatggtcacagcctagaggaacaagccaactaaggctgacagctaatcacaggattatgggatgcttccctcccctgcctcccaccctcaacatcaactgtagcaattagcattgactaagtgcctactactttttatgtcagaacctatgctataaactgcaagtgcattttctcaatgtaatccttacaaataccaagaaaaatagatattattattcacattttacagatgaggaaacagacttatgaaatgacttgtttaaggtcataaacaattatctggaagaattgagattctaactcaggtctgtcagatgctagaggcctgtgctcattctattatacttagctcagaaagggagagacacagtcagattttaattttaatgtgcatgcagaaaagcacatgggcaatcaagtcaataaattatcacaaatggaacacacccatgtatcaaaaaaaagaacttatcttccatttttccctgccaaagtcttcctgtgtctctctccaggcactattactgatcaaggataacaaatatcctattttgatcaccatatattcttgtttctttttcgagacagaatctcactctgtagcccaggctgtagtacagtggtgttatcacagctcgctgcagcttcaacctcctgggtacgagcaatcctcctgcttcagtcacctgagtagctgggactacagctgtgggccaccatgcctggctaattttttattttttttataaacaggatcccactatgttgcccaggctgttcttgaactcctgcactcaagcgatcctcctgcctcagcctcccaaagtgttgggattacaggtgtgagccagtgtgcccactctcataaccatatattatttttgtctgttactgaaccttatataaatggaattatataatatgtgctattttatgtcctggagcttttgatcaacattttatttttaggttccatcatttgttgcatgcaggtgtagttccttcattttcataagcagtatagtattacattgtatggctatatcacaatatatgtatctattctactgttgatagacatttatattgtatcaactttagaggttttaaaaatattgctgctatgaacattcttgtacatgtcttttggtgaacatgcttacagtttttccttgagtaatattcattgggtagttggaattggtgacagggcagagagggatggaggcagggagaacagctggaaggctgttgcacaagatcaagtataaagtttcaagagtaaagaagaggatggttatggtggggctggagagaaacaggtggagaggaaagagataaaagtgtttggattatagagtttaattggttcttgggaataaaggcaatagggaagtcaaagatgacacaacatttttaattccactgatagaggaaagaaagttgggctggaatgctcaatgagagagggagctcacaaatttcatggtgaaatgttcaggggatgaagaggaagtgaatagcctatatgggactgtttaatggacatctggaattagaggaacaaagtgagaggagggtggggaaaggaaataaagagagggaaaattttctggagagtattgattaaaacgcagttggacaatattgaatttggagaagcatcaccaatgtgaggagaggccagagagactgtagcgaagaaaacaaagaagacatggcctgagtggcagaaggatcaccaggctagaatcctattatggaagatttaaaagaagagaatttggggaaggtgtgtgtacagggaggggatgtattatattagattcaggatagacaaaagggggacaggcttctgagaaaggcccctggaatttggtagcagaaaagctttaaaaagagcaatttccatagagttctagtagcattacagagttctgaaaggagtgggtggagagagaatgcctataggggttccaaacacccacttaagaagggtggcaatgaacgaaatgattgaaagagagtgtcaataggctgaggaaaagcacccatggaaagagacaatgaatggtgtatgtggggtttgaggaggggttaaggtaaatgacagaacaaagtcgctgatataagtatatggagatgggggatgagcatagacagtgagctgattcattcattgaacaaatatttactgaatatatcttgcaagatacgtactatgctagggctggggatacagagattaataaatatagtctctaccctggagttacttgtggtatagtgggggaaacacttgatcacagtataagtatcaagtaggggaaaaggagactgtagaaacttccataatttctgcataggcctaagaagacttttggaggtgcagatatctgagctgacgtttgaaattaccaaggaaagatgaggaaattgtattctaagagggtgtagatgttgaagcaccattatttataataaccaaaggtgtaaacagtgtaaacaacccaaatgtccatcaattgatgacagagagcccatggttaaacatttaccagcacagcagtatatgggaaccattaatatggaggcagtaattaaaactatgtgaattaatgctatcacccaggtagaatacagaatgggatgagaagagggcccaggaattggactaggaggagaagcttcaaaccctcaaatttgaatccctcagtggtccttagaccagtaagaaggaggaaagttatgcttttcccactataaagctaaggtacctagtcaggaaggcaaagtgttggcaaattagtgttcatctgtctcctggagaccagccagagagtgagaaatgagcaagttgcctggactaaaaaatcccaccctgaaatccaagtcttgttaagcgaagttataaaaaaggacaggaatgcttgcattgcctaattgggcgtgtgtgtcgcagggtgggtggttgggaggaatcttcacatataaaaaacagctagcaacaagactcctttatttataaatttgtgcatctccacaagcatttaatgagcacctcctaggttccaggcttaggctagggacagttaacacaaaataagtgggtaatatgtcaacagtaagtactgcagagttgtgatcagaaaaatcttgagggaggtttgagctaggccttgaagactagctaagaagtacctggatggaaagaaaaggatgggaactgttttctaaataaagcataacagaaaaacagaaatgggaaaggaggtgggaaaaataatacttaacacttaaagatgtcttactatgtaccaaacaccattctaagagctttatatgccctatctcatttaatcctcaaaacagccctttgcgataggtaccattaccccaatttcacagatgagaaacagcccacaccataggtaaatggtagaagaagcattatgaatttagacagtctggctccagagcctatagtcttaactaatatcccatttacctcctggagtgtgcaaggtgttttcatgagggtgtgtggtgatagaggtccaattagatcacacagactgtgaagtcatgagtcgagagagtttgataggtaagaagggaggcagcttcaaagaatattgaattctagaggcttgcatcaagtgttgtagaacaagcacagcaggcccaactttgaatcctgaatctgccattgattagttatgggacatgggcaaagtcagtagtagccttcatttcctcatatttcaactgggtatgtcaatgccaattttgaaaggttgttgtaattattaaattaaaagcatgtaaagtgtccagcacagggtagatcaccataaatggaagctatgactattattactttatgacttgtagagttctcagcatagacttcagaagaactattttagtgttactagtcagtgatcccttaaaggcccatctaaatggaattcctagtgaaaatacatttactttttgggtcaattcctctcctggtggcttgtggctcagactactgaccctctatagctttgggttgctggtatcttccagttggcaagtatgaccatggacaggcttgagttaggaaagctgtcccacatatgtggccaccattcttagggggtagtgtgccaccattggggtgggaatagctaaaaaggagtgagattatatcttaactacttttcctgctattggtctatatgccattgctagaattgggagatgtctgcattgcccagtccctgttatctacaccagtccagagaatttggggaagctatgtgtacatggatgggatgtgttatattagattcagaatagactaaagggtgacagacttttccccatttcctagtacactctgctctctgatgaagtgttatgcctctcccttttcattttttggatctgctaagaaacttttaacctgcctgatatcttcctggaaatgtagttgttagaaggatgcaattgaaagcatgactagaattagctgctattctcaagaattttcaaactgtaaatcctagtagacaggacccaaaaaacagggagttgggaggagcaaaaccaattaattttcacatgtctgcaaatgttttaacgtacagctatcacccaaaatagaaaaccagagctttctctcttctaggttaaaaatgtctgcctagagatctgagacacttcttaaaggtgacctgcaaagggggtagggtggattccccacttgggatattatctataggctgtaaagtgggtctctgctgactgtctgcaggaggggccaggagagtcacactctttcctgctcgggccataattgctgcttactcagcaggcaaatgggcacgtatggcctcaaatttcagaatattcttttttcttgcagtggttctgaggcaggtgatcagactggcttagggcacatcagggcaagctgcctcaccttcactacagtggctctatgattctgctggcttcagctcttttctatgatcctctagaggacagtagacttcccagagcacatagccaacctgctaaatatcttcagaattggactgaaacaggagaagataagaattaatggcagctgcttgattaaagcaattcttgagcccaacagagaatgtgatggaggagtctgaaccagacattcttgattttattttatttttttttgagacagaatcttgctctgttgttcaggctggagtgcagtggcatgatctcagctcactgcaaccttcgcctcccgggttcaagcaattcttctgccttagcctcccgagtagctgggagtacaggcgcgtgccatcatgatcagctaattttttgtatttttagtagagacagggttttaccatgttagccaggatggtctcgatctcctgacctcgtgatccacccgcctcagcctcccaaagtgctgggattacaagcgtgagccactgtgctcggctgattcttctctttttatcacaccccacaccataactgctctttcctcacgaccaggtctaccttcataatttactcagaatttgaccattctttaatctttttcaccactaccactttgttctaagccaccattcactcactggcctccttactcctccacctgtttccacccttgcctgtctagtctgttttcctcacagcagccagagggatactttttttttttttttgagacggagtcttgctctgtcaccaggctggagtgcagcggcgcgatctctgctcgctgcaacctccacctcccgggttcaagcaattctcctgccttggcctcccgagcagctgggactacaggcatgcgccaccacacctagctaatttttgtatttttagtagagatggggtttcaccatgttggccaggatggtctcgatctcttgaccttgtgatccgcccgctttggcctccgaaagtgctgggattataggcgtaagccactgcgcttggcccagaggaatactttcaatgctgaagtcagatatgtcacttttctgctccaaatccttcaatgactatctcattcagagtaaaagttaaaatccttacaatgggggattcaggggatcatggcagacgggagacaggactagattgcacctcaagacacagcagcatgcagaggtttgcactgtgaattttacctccagatcgactgcaagaacaaaccagcaatgccgaaaggacccacagaccctctgaaggaagcagactgctcttgcaggagctgggagaaactccaaatactgtgagtgccccaacaggggaagtgggaaagggagaccctcctctcccaaacacacacccccactggagaagctgaatgtctgtttgtgggagaagtttccgactttacctggagctgagtcagcttggagaaccgagtgacatacaggggtagaggaagcagcagaaaggccccgggagctcgctgggtccccaagcagcccattcctgcctggcaccacagggatccatccggagggtggccagaggagcaggggttaaaacttcacaggaagaagaaattctctagctgaactttgtaacgatttgaacagggcgagaagcctcctggccagaactcaggggagggagcgaatcaggtgtgcagacttcacaggcttgggaagaactaaagcccttttctctcgcagctgggaggaggagagccctgggcaaattttgaagcccatctccccctcatcctggaaacagacttggggctgttgggggcaggcacagtgggaatgagactggccattcagtttgcgtgggagctgggtgaggcccgtgactgcctgctttcccccacttccctgacaaccttcatgactcagtagaggcagccataatcctcctaggtacacaaccctggtgacctgggaatctcctccccatcacccacagcagctgcagcaagaccaacccaaggagagtctgagctcagacatgcctagccctgcccccacctgatggttcttccctatcctccttggtagtggaagacaaagggcatataatcttgggagttctagagccccacccacactactacagctgatagtttctggaaagtgccacctcctggcaggaggccaaccagcacaaaaatagagcattaaaccaccaaagctaaggatccccacagagtcccttgcaccctccgccacctccaccagaacaggcactggtatccacggctgagagacccatagacagttcacgtcacaagactgtgcagacaacccccagttgggtagacttgctgggtggctagacccagaagagagacaacaatcactgcatttgggctcacaggaagccgcatccataggggatgagtactacatcaagggaacaccccatgggacaaaagaatctgaaaaacagccttcagccctagaccttccctctgacagagcctatccaattgagaaggaaccagaaaaccaaccctggtaatatgacaaaacaaggctcttcaacaccctcaaaaaatcacactagttcaccagcaatagatcaaaaccaagaagaaatcccagatttatatgaaaaagaatacaaaaggttagttattaagctaatcagggaaggaccagagaaaggcagagcccaatgcaaggaaatccaaaaaatgatacaagaagtgaagggagaaatattcacggaaatagatagcttaaagaaaaaataataaaaaattcaggaagctttggacacacttttagcaatgtgaaatgctctggaaagtttcagcaatagaattgaacaagtagaagaaagaaattgagagctcgaagacaaggtcttcaaattaacccaatccaacaaagacaaagaaacaaagaataagaaaatatgaacaaagcttccaagaagtctgggattatgttaaatgaccaaacctaagaataattgctgtacctgatgaagaagagaattctgaaagcctggaaaacatatttgggggaaaaatcaaggaaaacttccccagccttgtgagagacctagacaaccaaatacaagaagcacaaagaacacctgggaaattcattccaaaaagatcttcacctaggcacattgtcaacaggttatccaaagttaagacgaaggaaagaatcttaagagctgtgagacagaagcaccaggtaagccataaaggaaaacctatcagattaacagcagatttctcagcagaaaccctacaaactagaagggattagggccctatcttcagcctcctcaaacaaaacaattaccagccaagaactttgtatccagcgaaagtaaacatcatatatgaaggaaagatacagtcgttttcagacaaacaaatgctgagagaattcgccattaccaaactaccactacaagaactgctaaaaggagttctaaatcttgaaccaaatcctggaaacacatcaaaacagaacctccttaaagcataagtcacacaggacctacaaaacaaaagtacaagttaaaaggcaaaaacaaaaaacaaaaccaaagtacacaggcaacagagagcacaattaaagcaacggtacctcacatttcagtactaacgttgaatgtaaatggcctaaatgttccacttaagagatacagttggattaaaatgttggctgtttttgttaatatacttaaaactgtaaccagtgaataacacctgtagtattttttattatagattatattttatttcaataaactttgatatttagacaaaagagatacagaactgcacaatggataagaactcaccaaccaactatctgctgccttcaggagactcacctaacacagaaggactcacataaacttaaagtaaaggggtggaaaaaggtatttcatgcaaatggacaccaaaatcgagcaggggtagctattcttatatcagacaaaacaaactttaaagcaacagtggttaaaagagacaaacagggacagtatataacagtaaaaggccttgtgcaacaggaaaatcaaaatcctaaacatatatgcacctaacactggagctcccaaatttataaaacaattactaataaacctaagaaatgagattgacagcaacacaataatagtggggacttcaatactccactgacagcactagacaggtcatcaagacagaaaatcaacaaacaacagattcaaactataccttggaacaaatggacctaacagatgtatacataacatttcatccaacaaccacagaatacacattgtattcaacagtgcatggagctttctccaagatagaccatatgataggccataaaattagactcaataaatttaagaaaattgaaattatatcaagcactctctcagactacagtggaataaatctggaaatcaacatcaaaaagaactttcaaaaccatgaaaatacacggaaattaaataacttgctcctgaatgagcattgggtcaaaaatgaaatcaagatggaaatttaaaaattctttgaattgaatgacaataatgacacaacttatcaaaacctctgggatacggcaaaggcagtgctaagaggaaagtcatagccctaaatacctatatcaaaaaagtctgaaagagtacaaacagacaatctaaggtcacatctcaaggaactacagaaacaagaacaaaccaaactcaaacccagtaaaagaaaggaaataaccaagatcagagcagaactaaatgagattgaaacaacaacaacaaaaaatacaaacggtaagtgaaacaaaaagctggttctttgacaagataaataaaattgatagaccattagcaaaattaaccaagaaaagaagagagaaaatccaaataacctcactaagaaacaaaacaggagatattacaactgacaccactgaaatacaaaagatcattcaaggctaatatgaacacctttatgcaaataaactagaaaacctagaagagatggataagttcctggaaaaatacaaccctcctcacttaaagcagaagaattagataccctgaatacaccaataacaatcagtgagattgaaatggtaattaaaagttaaccaacataaaaaattccagaaccagacagattcacagcagaattctaccagacattcaaagaagaattggtatcaatccttttgacacctattccacaggatagagaaagaaggaaccccctcacccaattcattttatgaagccagcatcacccaaatactaaaaccaggaaaggacataaccaaagaggaaaactacagaccaatatccttgatgaacatagacactaaaatccttaccaaaatactagctaacagaatccaacaacacatcaaaaatgtaatccaccatgatcaagtgggtttcataccagggatgcagggatggtttaatgtatgtaagtcaataaatgtgatacaccacataaacagaatttaaaacaaaaatcacatgatcatctcaatagatgcagaaaaagcattagacaaaattgagcatccctttatgattaaaactcttagcaaaattggcatacaagggaaataccttaatgtaataaaagccatctatgacaaacccacagccaatgtaatactgaatggggaaaagctgaaagcatcccctctgagaactggaacaagacgaggatgcccactctcaccactcctcttcaacatagtactggaagtcctagccagagcaatcagacaagagaaagaaataaaggacatccaaattggtaaagaggaagtcaaactgtcactatttgctgacaatgtgatcatttaccttgaaaaccctgaggactcctccagagagctcctagaactgataaaaaaaatcaggaaagtttccagatacaagattaatgtacataaatcagtagctcttctatacagcgaccaagaagagagtcaaatcaagaactcaaccccttataaaatagctgccaaaaaaaaaaaatacttcagaatatacctaacaaaagagttgaaagacctctacaaggaaaactacaaaacactgctgaaagaaatcatagatgacacaaacaaatggaaacacatcccatgctcatggatgggtagaatcaatattgtgaaaatgaccatattgccaaaagcaatctacaaactcaatgcaatcccatcagaataccaccatcattcttcacagaattagaaaaaaaattctaaaattcatatggaaccaaaaaatagcccacataaacaaagcaagactaagcaataagaacaaatctggaggcatcacactacctgatttcaaactatcctataaggccatagtcaccaaaacagcatggtactggtataaaaataggcaaatacaccaatggaacagaatagagaacccagaaataaacccaaatacttacagctaactgatctttgacaaagcaaacaaaaacataaagtggggaaaggatacccttttcaacaaatggtgctggcataattggctagccatatgtaagagaatgaaactggaacctcatctctcaccttatacaaaaatcaactcaagatggatgaagatcttaaacctaagacctgaaactacaaaaattctagaagataacattagaaaaacccttctagacattggcttcggcaaggatttcaggatcaagaccccaaaagcaaatgcaataaaaatgaagataaatatctgggacctaattaaactgaagagcttttacatggcaaatggaacagtcagcagagtaaacagacaacccacagagtgggagaaaatctttaccatctatacatctgacagaggactaatatccagaatctacaatgaactcaaacaaatcagtaagaaaaaaacaaacaatcccatcaaaaagtgggctaaggacatgaatagacaactctcaaaagaagatatacaaatggtgaacaaacatatgaaaaaatgctcaacatcactatcagggaaatgcaaatcaaaaccacaatgggataccaccttactcctgcaagtatggccataatcaaaaaatcaaaagacagtagatgttggtgtggatgggtgaacagggaacacttctacactgctggtgggaatataagctagtacagccactatggaaaagagtgtggagttttcttaaagaactaaaagtagaactaccatttgatccatcaatcccactactgggtatctacccagaggaaaagaagtcattatttgaaaaagatacttgcacatgcatgtttatagcagcacaattcacaactgcagaatcgtggaaccaatccaaatgcccatcaatcaacgagtggataaagaaactgtgatatatatatatatatacacacaatggaatactatgcagccgtaaaaaggaatgaattaacagcattttcagtgacctggatgagattgaagactattattctaagtgatgtaactcagaaatgtaaaactaaacttgtatgttcttactgatatgtgggagctgagctatgacgacacaaaggcataagaatgatacaatggactttggggacttggggggaagagtgggaagggggtgagggatgaaagactacaaatatggtgcagtgtatatatgggtaatgggtgcaccaaaatctcacaaatcccactgaagaacttactcggccaggcgtggtggctcacacctgtaatcccagcactttgggaggccgaggaggccagatcacctgagctcaggagttcaagagcagcctggccaacttggtgaaaccctctctctactaaaaatatttttaaaaaattagctgggcatggttgtgggcacctgtaatcccagctacttgggaggctaaggcaggagaatcacttgaacctgggagttggaggttgcagtgagccaagatcgcaccacttgcactccagcctgggtgacagagtaagattccatctcaaaaaaaaaaaaaaaaaaaaaaaaaaaagacttactcatgtaaccaaataccctgtgtaccccaataacttatggaaaaataaaaaagaaaagttatccatacatatatttactattaaatatatcatatatgtccaggaggtggttgggaaactctagtacccatcagaacttgttaaaacaaagattgctacactccctgccccagggtatgtggttcagtatgtctagggtgaggtctaaaatttgcattttaacaaatttctaggcttctggtaggggaccacactttgaaaaccactgatttgagagattaaaagaaaaactttaagtttctttttacttgaaataagcctgaaaaatcatctagttaaatttctgtttgttacaagctttaaagagcagctagttagatcttaaataagtataaatatgaagagcatatagttaaatgttaaggccttggtaggctaaatggtatctccaatatttcacatataggtaacaacaaattgagagctaggactccttgttcactcatacattttgttgaattgtctccattggtctggagaatgtctccttttaatgtatcaactgtttttggcatgatggctatgtactgttgatgtatgtaggtttaaaaaaatgagatctgggagtttaaatgcaagtactcaacacagtatcctgagtaattagaactgtgtctattgcaaaaaggctgatcaataaatacttaacaaaatgaaaaaaaatccttacaatgacttacaagtgcctgcatggtttgttccctcgttagctctacaacatcatatcctacgacttttcctcatgctcactctgttccagccacactgttatgtctgcctggaaaaatcttccccaaaacattcaaataatttactcccttacctccttcaggtcttaattcaaattatgtcccttttcagtgagatcttccctcactaccctatttaaaattaaagttatccatactccttatgcctcttcctcatttcatttttcttatagtactcatcaacatctaatacaccacatttatttcattaatttgtttatagtctttctctccctctgcaatataagcttcatgagggcaagatttttgtcttttaaaaaaagcactggatatccccagcacctagcacagggtctggcattggtagatgcttaaaattttttgttaaacaaatgttcttaaaaaatgctcatggctcagaaaaacattcctttccctagctggctctcagtttcgcctattgatagcataagggagttggattgggtgatctttcaggtctcttgtatctctaggactaaatctagagatcgggtgaaaagtacaatcttgggagccagatttcttgggcttctcctcctgctgccttgagacaggtcacttcacctctctgggcctccagtttttgtatctgaaaagtaaagatgataaaaatagaccctgtctcaaagggttgctgtggagattaaataagatcatccatatataagcactttaacacagtgcatagtgtttaataaacattaactattgcttttagggtgatcattagcaagtagccacattaccagccttgcttaggctcataatcagcttcagttgctgatggtatgaaaaaaaaaaaaagcaaaacaacttccataacaacaaattcacctgaggttcatatgcagctcatatgcgactcatatgcatacagctggcctttcccccttcctccaccccattactaagacagaagaacagcctgttctcttgtaacctgatgtccctggataagcgggagggggagagaggcaacgtgtgattgccatggccacccgctgcatttcaagttccacagagaagcagggtatgggggcttattcacaatcacccacaaacctggccatgggtgccttcaaccagagtgtgtagaatacatgttgttccagtggcagaggcccatcacagatgttctactaggagggcaaaggatgatgttcaaagccatcagcagcatacgtgattcagacagctggccaggtctttggggccagagatgcgtgggcttgccagagtaaggcaggatgtggataggttactggaatggaaactagaaacagtaaccaatgaaaaaacctaataaaatgataagaatattaataacagcttacatttcttttgaatatattgtgtaccaaatgctttgtacatgttttcatttaattctccaatgaactcagtagttctcaactttagctatacgttggacaaacttgaaaaaaatcaatgctctggccccaccgcaccaattaaatcagaatgtctagcaaaaaaaaattaatctccccagataattataatgtgtagccagggttgagaaccctctgttcaccagatctaggcttaatgcagcaacagcagtgacattaggccattatttctttaaccatggtatgcgtaccactggctgtacacaaaatgatttaggagataaatgtgagcattttaaatgtcaaagttatgtattcatcttgatgtatattagaaatatacatctatctataatacatatagcctatgatttcacaaacattgcttaaacaatgctaaattgatttaaaatattgaaaagtgacttgagttaaagaaatatatgaaataaatgataataagttgacataagaatatggctccaaaaattcagaatgggatagatgaatggctgaagaggaagaaacactatctgaagtcattcatttttttcattcaataaacatttactggaaaatgattatgtgacagatattatgttagacacaatagacagatgaggaaagaataagaaatggttcttgccttcaaggatctcacagaaaagaaaatatacaatggcaattcagtataaataagcacagggtatagtgggaatgtatggagggggcaggttatggagacagaagcagtggggatttaggaagattaccaagaaaaggtggctggtcatgtaaaagggagagggaggaaaagatgatgtcaagatgagggcagtaggaacaacgcacagaagtgagaagcagcagggtgtaaagatgcaatggttggcttgggggaggggtgaagaagggagtattcaattactagagcaaaacatacaaggcagggaagtgaggagagaaaaggccagaaagatttgcctgaattggattattgcactccaagaagaagggtttgagctttattcttttctttggacaggcttgactttatatctgggctagagggttaatattcaaatcctagttttagcacttttttttttttttactgtgtgtcagtgggcaagttgcctaacctttcttagcttcagttttctcatctgtcaagtggaaaattaatagatacctttcttagcattaagtgtaggaggttaaatgagatctcatttataaatcatttttcatggtgcttggcacacaaagtaagtcccacttcttgtctgttcttccctggcagaaaaaaaaagagcacatctcttgtcagcagtgtgtgtttataatatgagtcaatctgtattactctctcattttatctctatattcaataaacttttaaaaaacatctgccatgtagcaggccttttgcctattttattttacttaatttgcacaagggccctgatgacaggaagactgtgcagtgaaaagtccagtgaaaagggcagggctgctgatgctatcttaacttcaactagaacagctatgctttggctccacaatgcttaaggtacaagggattccacgtttctttattatttcttcatagatgaaaaaacatcaagaactgttttcctgactctgggagagaaaaaatagctgaagacatagggccctatatgctgaaaatttgccccagtgacctctactagcctgagagtctggaggcattattggtgtcttccagaatttagcttctttgtctcctgatattctattttttttatttattgtggtaaaaaaaatacaacatcacacaaaatttaccatcttaatcattttaaagtatacagttaaatagtgttaattagattcaaattgttatgaaacagatctccagattcttttttaaatcaaatagaatactctatcagtatgttcattttgtggtaattcactggtgtgtaagtctaagatttgttcatttttttctctagttatgtcgtactttaagaaacaggttttttaaagtaatgacattgcataaaacaccagtgactgttccagttaagttattggtgaatgatccagttggctatagaaattagagatggtaagtttcttaaatgtaaaacaaaaacaatatatttttaaatgccctacacaatttagaaggggaaagaaattagttcaatactaagacatcttaaccagcagaaaagagaacagagaggtcttctagttcaggtaagatgacatacatagactcctttcttgttgctcctccccactagatacaactataaattctgataataaaccttttttttcctgtgggcctggagtacttggtggttaggaggtcacctgtaagaggaatcccttcagaacaagtgacccagcctggaagcttctttgtgtccttgggcctgagaagaccctcccccacacagacaggccaggttgcccttggggtagggggagtggatcctgcacaacatatggccaattgcaggaacccttcttcctggagactcccttttcccacctagaggcatcataataacctagcctggggaagcaccttctgcctccacaggccgaatcagcatagaccagggaaagcctcaaaggcaccacgtaaaccaagcagatgaaagcacagtaaaagctctgaaaattaaactgtcactggaaccacagcacacaagagtaggccaggacttgcatgctaaacctaaacaaggagacttcctaaaatagaagattgacataggactctcagactttcctaactcaataacaaaaatgtggatattttgtagaacatattttaaaatcacctgtcataccaagaaccaggaaaataagttgaacgagaaaagataaccaaatgatgccaatatggagatgaatcatatgttggaattatctgacaaaagttttaaagcagtcagcataaaaatgcctcaatgggcaattatgaacatggtagaaataaattaacaaatgaaaatttcagcaaagaaatagaaattatataaaaaagaaccaaatgcaaactcaaaaatacattaatgggaaaaaacacacccaagtaattatgctgagtgaaagaaaccaatttcaaaaggttatgtactgtatgattccatttatatgaaattattgaaatgacaaaatcattgaacctgagaacaatttagtagttgtcaggatttagagttttggttcaggagagggaaatgtatgtggttataaaagggcaaaatgagagatcctgtgggatggaactgctctatatcttgactattgtggaggataaacaaacttacatatgtattaaattgtatagtgctaaatacacacacatacatacacatacatagaaaggagtataagtaataccagagaaatctgaatatcagtggattgtatcaatgtcaatatcatggctgtgatattgtactatttcccactgggggaagctgaatgaaggttccatgctctgtattatttattgcaattccatatgaatctatatctcaaataaaaatttaattaaaaattaatctatattttaagtgcttaattaaaataaaatcgattctctgattcatgaaatagagaaaatagtattttattgtgaactatggctttgctttgttttaggtaaatgctagtgttggcataaatttgtaaaacataagctttgttagtatatacatatttttgaaagttacatttcggggcaattttgaggtgtggaacctgaagttttattgcaggacttagtgcagcttcagaatcagtgcatttaaaagctagaacaatgttggcttttaactccatatattagatttatcaattattagaaataaactgccatgtatattcatttttaaagtgcaatagaatctatgtggattcaattagaaaacaaatacatcctatatgagctctcactcagcagagttggctagaagtccaatatcaatttctttgtgggattctttcattttcctttgattatatccaaatcttggggtttaggcagtctgggaagaaaagaggaagggccctggttaccaggctgtggcgacaaaaatctcattgctcctcttctaggctggtgtggtccattcattcaaaggtgaactttgcgattccctgctaaactccctctttgctgagttctgcaatggagactttcactggggcacttcaggcttgcctaataaccaagtcttcacagagctaccactatcccaggcctgtcaccaccaatgtgttctctatgaacagaagcagaactagaaaactggtggttctagtttgtttcttgccctgagggaagctgtacaacttaccaactccccgctgctctatcttggcaactcagcctcatccccatgatgagcttataagaaacttcactgtgtatcacgatcacccaagagcttgttaaatatgctacaacctaggacctgccccaaacctcctggtgcctttgtttattaatccatttcactgaaaaaataaagagcaaagtatttggacattaaattagtagtatgtcaccctgccatgtaaataaaaaattttatttgaaactggctagccatatgcagaagaatgaaactggaacccctacctttcaccatatacaaaaattaactcaagatggattaaagatttatttttattttttatatttacatttattttatttttccataagttattggggtacaggtggcattttggccactttttcaaaaattataaataaatttcaaggtggctacagcagcacattaaaccatgtgcaaggtccttctaggcatggggccctgtgagactgcacaggtcacatgaccatgatgacagtcttgaacttggcagagaggtcagggtggtaggtatggatttgggagtcattggcatgtagacggtcttttacataatgagagtagaggagattatctaaggagaacttgtagagtgagaaaagcagaggaggttgaagataaactccagggaacaccagcagtataagaataaacaggaaagagctctcaacagtgtgcaggcaaaagaggtggaggttaagagaacaaattttggatctagactggataaagaaagtgtggcacatatacaccatggaatactatatagtcataaaaacggatgaattcatgtcctttgcagggacatggatgaagctggaaaccatcattctaggcaaactaacacaggaacagaaaaccaaacaccacatgttctcactcataactgggagttgaaaaatgagaacacatggacacagggaggggaacatcacacaccagggcctgtcgggggatgggggggtaggggagaaatagcatcaggagaaatacctaatgtagatgatgggttgatgggtgcagcaaaccaccatggcacatgtatacctatgtaacaaacctgcactttctgcacatgtatcccaaaacttaaagtataataataaaaaaaagaaattgccaaattgtttttcaaagttaccgtaccatttttcatccccactaacaatttataagaattccagttgctctgcatccttgtcagcacttggtattgtcagctttttaaaaaaaattttagccattctaatagttgtatagtgttatcttttttgtttttttttttttttgagatggagcctcgctccgtcacccaggctggagtgcagtggcacaacctctgctcactgcaagctccgcctcccaggtttgcaccattctcctgcctcagcctcccaagtagctgggactacaggcgcccaccaccacgcccggctaattttttgtatttttagtagagacagggtttcaccgtgttagccaggatggtctcgatctcctgaccttgtgatctgcctgtcttggcctcccaaagtgctgggattacaggcatgagccaccgcgcccagccgatttgtccaatatttttctaatgactacactagagttactggtttctacagaagaccacaaaggtaaagtgccattctcataatatcatatcaagagtacatactgtcaacatgatctttcacagttgatgttaaccttgattacttagctaaagttagtgtttgtcaggtttctctactataaagttattcttttttcctcctttttatatcatactctttggaaagaagtctctatgcacagcccatacttaagtggagagtgatgttccatttccttaggggtggagtatctgcagaaattattttgaattcttatgcataaaagatgtcttcccccatttgtttatttggtaatttatatcactatagacttatggatatttattttatactttggcttatagaccaatattactttattttgttgctcaaatcgttccagctttggtcatttaaaactctttcagttggtatgtatgtccctttaacatgcccccatcactgtgacttttttgagtacttccttattttctggaactacaagatgctccaggcttgtcttatgtctttcctgtcccagtcctagaatcagccatttctccaaggagccttggttccttttattggaaaatgatattaaaaaccaatatctgggttctaggtgtgcctgttgctactacagtgtcattgtttctaggccctctcacagagctaggaaatacatgtatgtatactagccatggatacacacaattctttctatatcggtttctatgctaagctaaacataaattcatactgatgtctccaacagtaatagcaatattacatggttcattctagcctttctctcttgcttatctgtaatatctcactctaacagtgagaaacctgtttgccaccaaccacttatttgttcaatcctggtatacatgtacagtggtttcagaattgttaacctgtgcccctgtgaaaaaaacaacttgtggtaaagtgcttatgtatggttcccatggtcttcagttttgtacttttcggccatattcaaagttactgaggtcagtacttccttttccccaacccttcggttaaattgtgccatatatttgtaatacagttatattattttgttacagtctacattccaacctaagatccccaacttcctagttgagttttaaaatttgtatacattaagtttactctttatgttgtaaagttctacgaattttgtcaaatgggtagtgtcatgtatccatcagtacagtaccatatataatatattcatatggtacataaatcccctgtgattcacttaaccttttctcctccccaaatccctggaaaccacccatctgttttcagtctctacagttttcccttttccacaatgtcatataaatgctgtgtagtatatagttttctctgactggctttttaaacttagcatatgcatttaagattcatccatgttattgcatgatatctcattccttttaattgctaaataatgttccatagtgtaaatgcactacagtttgtttatccattcgccttgaaggacatcttggttgcttccagttttttgtaagtaggaataaagctgctataaacatttgcactgaggtttttgtgtggacataaattttcaagtcagttggctagtacctaggaacatgattgctggatcatatggcaagactatttttatcattgtaagaaactaccaaactgtcttccaaagtagctgtatcattttgcattcccagcagcaacgaatgagaattcctgttgttccacatccttgctagcatttggtgctgtcagtgttctggattttagccattctaaaaggtgtgcagtgaacaattttgagtttttgtataaataatctcattgtcgttttaatttgaaattccctgatgacatatgatgttgagcatcttttcttatgcttacttgtcatctgtatatcttctatgatgacttgtctgttaagatcttttgtccatttttaaattgagtcatttgtttcttattgatgagttttaagagttctttatatgtttggatacaagtcctttatcaaatatgagttttgcaaatattttatatatactgtcttttcattctcttaatattgtctttcacagggaagaagtttttaattttggtaaggcccaatttatcaaattttttcttttataacatgtgctttcggtgtggtatgtaagaactcttggcctaacctaaggtcacaaagatattctgttttttcttctcaaaatattataaattctacattttaaatttagccttaggaaccattttgagtttatttttgtgtaaaaataattcgggttcattttaaaaatatatggatgtccaaatattccagcaccatttattgaaagactaccttttctcttgtttcctttgaatttttgtcaaaaatcagttgactctatttgtgttggactacttcttggcctctattttttcacttgatctatgtgtctatccttctgccaatacaataattacctttattttttatagcaggataataagccttaacatccaatagagtaattcctccaaataccacactgtgttgatatagttaatagtaagtcttgaaataagatactacgagtcctccaactttattctttttgaaaattattttggatatcctagttcctttgcctttcaatatgaatttaagaatcacctcgttaatatctagaaaaaaaatcctgctgggattttaattgagtttgcattgaatttatagatcgattttgggataattaatatcttaacaatattgagtcttccaacatatgaacatggttcatatctccatttatttagtttgtcatatctttcatatatgtttcatagcttttagtatacatatcttgaacacttttattagttttctacctatttcattttttctggtataattgaaaattgtacttttaaaaaaaactttcgatttctaattgttcattgctggtatacagaaatgcaattaatttttgtatattgaccttttattcagagaccttgataaactcatttattagttttaatagttcttttgtagattccatggaatttcccacagagacaattttgttgtgtataaatatagttttattccttcttttatattctgtatgccttttatttttctagtgttattgcgccaggtaagatttccagcatgatattaaataggagtggtgagaatagagatgcttgtcttttccatagtcttaaagaaaaagcattcaatcttgcatattaagtatgatgttagttgtagatatactgtattagattaaggaggttccttctattcctagttagctgtgagtcattttaaaaaagtttgattgaggtataatttacattccatgaaattcacctatttaaataatttctagtaaatgtatagttatgaaaccatcaaatccagttttagaacattttcccctacccgcagttccatgaatcctcaatcccaggaaacctactttcattgtcttttcctggacattttatataagaagggaaacactgccttgtattcctgtatttggtcactttttgtggggggaatcaccccctttcagtgccgctaggccttccagtgtctttaggtgggcgaatagagtttccaatccatagagtacagaaaaatgttttccaggcaggacagcttgttgtggtggggtcaccctgcttgtaccactggggccattgggtgtctctaggtgagaaaagaaactctctggcccataagaatgaaatgcactttctctggtcacttatcattactggagctcctacttgatcaccagtgccactgggcccaactggagtaattagcaggactcccaactgatctggagaaggcatgagcctacctgagtaacctttatctgatatgtcagggtcaggagattccaggcctaaatgccttctgttgctgggtgaggggtggtaagacacacaactgctatgttgctcttccagtactggggtccctagccagtccatcttcctctttccaccattcagagtcctcctacggttgcttcttgtgttatgtcatagttatatttagcaaagagaagcagaaagagatgagtttatgtcctcttgtctggatcaaagtccctagaccatttacattttaatgtaactatatatgtctggatttaagtcttccattttgtgtgtgtgtgtgtgtgtttgtgtgtgtgtgttctgtttgttccctctgcttttcatttctctgttttatttttcctttggatcacttcaatatttttaaaaaatcggttttgattcatctgtagtgttcttgagtgtatcttttcatataaaatttttagtggttgtaggcattacattatacataaataacttatcaatgtctacagacattttaacggtttgagtgaggtatagaaatctcatatcctcttaaatttctattcttcccccatttataattttctcaaatatttcctctgtatacattaagaacacaatcagacaatattataatttttatttaaactatcaaatgtaatttagaaaacttaagtggagaaggaaagtctattgcatttacccatattttaactcttccattgttctttcttcttttctgatgttcccaaattcgttcttttatcatttttttcatgcttcaagaacttactttagccatagcaaaggtatattggtgacagattcttttagttttcctttgtctgagaatgtcttgatttccacttatttcctaagaaatattttcactggacatagagattagcctataattttcttttttgtcattttgttgtcttcattttcctttgaagtaagactcaaagcccttgcagggctacagtctagcataacactagatttgtaatactcactattctatgttttattttagaactgttattcacatatgagagggtgcctctgaagttgtgcaaaataaacagccaattgctgaaagtaagaggaattggagaggtttaaggaatacaagtggagattttaataggcactgaaagaatgggagagggaactgacaagtaaaatgatggctgagtgatgttgagggtccagctgagaaaacaagccatctctttgtagtggcttcaatctgcatagctgggtggttttcttttgcagcctgaaatagagggtagttggaagcagcagtgagaggataaatttaaggaaagctttaaaagttttgttcttgtctctcctccaattgcctacctacattatctacccttcactacagaaatcggcagaaatatctccaaccatagttaccagtgtatggagggtgtatcagagtatatcagggcagcaaaaaagccctgcttggttgagtgggaggctgttgaaaacagatagggactcccctgctccattgttcattcactcctccacacttttcaaatccccaaagttgatgagttacaacctgggacactgatacccccccagcactgcttctttcaaacaagttttaagatgaagccttgatcatatcagttgcttatagagtggcagcaaatgggaattattaacatgttctgagctacctggggctctcctttcctcactcttcaaacacaatgaggctgacatagactaatacagagaaggtaaagtgcatgcacacatacacgcacacacacaatcacagaacttaaacataaacttctcaaagtttccagagagaaaaatcaagtcctctacaaagaaaggaattaaattgacaacagacttttagcaacattgaatacaagacaatattttaaaggactggacctgtaatgcttaaaatgactttgaacctataattttatattcagccatttttaaattaattaatttatttatttttataaattttttgagacggagtctcgctctgttgcacaggctagagtacagtggcgtgatctcgactcattgccacctccacctcccaggttcaagcaattctcctgcctcagcctctcgagtagctgggactacggtgcgtgccaccacgcccagctaattttttgtatttttagtagaaacagggtttcaccgtgttagccaggatggtctccatctcctgacctcatgatccgcctgcctcagcctcccaaagtgctgggattacaggagtgagccaccgtgccaggccagtttttgtatttttagtagagacagggtttcaccatgttggccaagctggtattgaacccctgacctcaagtgatccacccacctcggcctcccaaagtgctggaattacaggcatgagcccctgtgcccagcccattttttaacttaaatgtagcatagtaataaatatattctgtggcatgcactatctcagaaggtttgtcacacaaagaccctcattgaagacaattttggaggaggtcttcaaattagaaaggaaaaaaatacaggagatgctgcaaagacatggggagtaagggcaagtatacactggtagtatagtttattgctgacttgataattaaatactgagcagaaaagaagaaaaagtgtatatccatagtaactcagaacagatatttttaaacattatcaaagtgatggggaaggtgtggtggaactcaaaaaacatgagaacattttcaagtacttgtaatgttaagagaaaaatgtagatactgataaatttaagaaactaatatggttaaattaacatgggtatttgttagttaagggcaactaaaataagaaccaaaatggcagttataacttgtaaaccagaagaagaaaattcatcctattttgtagaaaataggaaagaagaaaaatataagtgattcaaaaatgatttacagtgtggatttcctctaaatgttgaaaacatccactatgtgtcctgggtgacagtggttgaagcgaagtagaattgaggcattcaacagaactgagaagttaaggtgttggatgacatgtctgcatggataccattaccagagctgagaaaagtttatcctcctttaagacttctgtctttgtattttcctcccctctatcctcttggcaaaaccctataatttatggggaatgaaaaaattaacaattttaatcggagagggctgtatgggaagtagaatcttcagtggagtgccaggtctcaattacagatgtgcaggaaatgttcaaataagagggacaacatttctgtatattttcataggctgagcttattttactgtgcaacagggcacccgggaaaactgtggaaaggtttaaaaagaggggattctgtgatggaagataactggggaaggaattcatgattatattatgagagtaggaagaggataggtgatagtgtgaggaggtgcttgcctttgggtggtgtctagggattacaaggataaaaagcatagataaaattggctgcacacaaaatccccaacattacttcacattgttttatatccagaatgagctgaattgttagatgataaacaaccagcacccctaacattgtcccacctcctcactgtagtttacttgctgtgttcaaagcagagataaagcctcctccagtccccattcttcctttcatctcttttcttcctctcccatctctcacttctccctcacatccccatatcacatcactacttactgcctctggacagttcagtggctagacaagattacacctaacgtaaccattggacaactcataggactttagacaaaggttgccaccttgtggtcagaggcaaaaataaccaagggtcttgggtcaccgacttgagtgtacatcagaatcagctagagggcttgttaaaatagaatgctgggccccaatcccatatttgctgatttagtaggtctgagttgggacttaaaaacttgtatttctaacatattcccagatgatgctgccattgttgcttcaaggaccacactttgagaaccactgctttagacaaatctttttcaggataggtagacctccatttggtcatccaagattggtagaattagagtttgaacacaaacatgtttgaattaattttttgctaccttattattaggaaatgcatgtggtactgcttgggcaacagcctcacttgttttctttatcctggacaaggtaaccactaaataaagaaagaagtggcatccattctccctgcatagattgaatgtaccatggtatatgtaacaattccagtgccaggcacagtgcctcatgcctgtaatcctaacacattgggaagccgaggcaggaggatcgcttgagctcaggagtttgaagctgcagtgagctatgattatgccactgtactccagtctgggccacagagtaagaccccacctcaaacaaacaaacaaacaaaaaaacacccaattcttttactgttggacatttaggttatttccaaattttcacaattgttaaacaaatttaaagttaactctcttgttccaaacccttctcttgtcatttcctgaataccattgatagaataactttgatgcaatttaatgatgctaaagtctcctgagtgaggatgggtaggatcaaagggaatatgggagccaaaaaatcctattccaccaaaagtactactataagcaaaactggacacaggctcctgctctcttggagattacagtctagcacaggattcaaatattaatcagctattcatacaagtaaatatagagttgtggatgtaaaaatgctgtgaaggaaagatcaacagtgtggtaggcagtgtgatagtacttgggaattttgttcccagattgtaataataaacttttaaaaattggctactaacattttaataataaatttgttatgattaatattttgacatattttcaaatttatgcctgtatactggaatttcaatatataatgaggatttttggatttgggcttagtttttgcttaatcttgattttgatacctagctgtgggggtttgtcctgcagaccttgacttaatgatggatgaataacatatactgacacagatattttgcctgtcagtccggctgagggtctgggccacttatagacaccaaggagggtggtgtaaagagttgcagctgcagccctgacttgctggccctactggcatttatttagcacacattaaatgacaaaggctttgggtcaacaccattagagggtaattaacctggtagccttctccctgagagagccatcctgcccttgaatgatcaaaggttagttttaggaccacatgaataaacaagttatttagataaactcctctacattcctatgtatctatgccctaagcttttaagagaattcagctgccttcagccaaacactactgaaaccatgcaaacccccaggccttccaagagggtttgtgtttatttcctataatttcacaatttctcccaccatcctgactgaacccctacacctagccaagcatcatttggctaaaccgcagattaagtgaacctctaccacatatcttataccactttgcctctctgtgggggaaaatttttcaggtggtctttatgatccccacctcctggtgttcacacccctgtataatcccctcccctggagtgtaagtgggaagtgtggcttgattctaaacaatagaatatggcaaaggtgatgggatgtcactcctgtgattacaatatatgactccatcttgctagctgattttagagtctttctctctccattgcttgtttggaaaaagcagccagccataagtcttaaagccacaaggaaaggaactgctcagaactagagtgagcttggaagtggatccttcccctgtcaagcctctaaatgagagcccagccctgaccaagaccttgattgcagtcttacagaggacccagctaagctgtgccttgacgtgaaaaactatgagatagtaaatgtgagtcattttaagccattcagttgtggcatcatagtaaaggaatatacctcctcagcacttcaacccctttgacttgtattcagcattcttggtctctcatatgacactccctctacccggattgttccctctccttcttcacttcacttttgcctagctaactctttcaggttttaactgaattgttacttcctttggaaagattctcttaacttccattttggagatttttcttccttgaaaaatttggattgacactggttttaagtcatcctcataagatgtgaaaaattcccaaataagattttttcctaaaggaatcatgaaatgattaactaaaatttaatatgtacataaaggttattttggttactattgtgaatgctaacacctcaaccaagtgtatagtttaaaattataatatacttgaacctctattatttaaagttttcaaagactgtctcaaaattgatataatattctccctaaggttatttagtgagtgtatgctctcataatttgtattaactaccaatctgcttccatatttaactatttggaagttaagttttatggagataaatttaagagttcttacaatcagcattattgtattttattctttcaaagatacacatttatttttcaacggattgacagaattaaaatatatagaacataagagattttctccctagttttatctagaatgcttaactatgttttaaagtgaatattaaaatattaataactccaaatgacttccattattcatattactgtcattattatgcagtagcctaggtgatcacctgatcattgatcatgcacaagtttaagaatgtcagaaataatggttttggtagactgtattatttgttaaaaattattcatttcgtccccaccctataggtagagtataccttagtgtccaattgtccttaggactggctagtcagtgacttgctttagtcaatagaatgtaagtagatgtgatgtgcagactctaggatggcctccatgttcctcacctcctagtattcatgccctggtacaatcctctccccttgagtgtgatggccctgtgacatgcttctaaatgatagaatatggcaaaggtgataaaatgtctaatttgtgattatattacattctatatgatctagtcttactatcagattcactttagagactctccttactagcttgatgaagtaagcagccatgttgccatattataaggaactgtggcaaggcttctaggaactctgagcagcatctaggaactgcaggcagccactaggaggtgagggtggcctttaggatctgaaggtagtcttcagctgatagtcagaaagcagtgccctcagctctatggccacaagaaaatgtatctgccaacaatatgagtgagcttggaagcagattcttccacagtcaagccttcagatgagattgcagcctggctgacaccttgactgcagctttgtgaaactgttaagtagaggacacagttaagttatgctcagacttctgacccacagaaactgtgaggtaataaatatgtgttgttttaagctactgagtttgtggtaatgttataatagaaaactaatacaatgggcatgatataccctacatcagagcagccacttaaatatcctttcatggtttggctctgtctctcttgagcttttgacttccaaaaggagaaacatgtacccaagagagttgcagatctttcatcttcagtccctgaatcagaagattcatgatggtacctgaacccagccaaggccagcaaagttgtagctagccattagccttcatgtgagatgaaaagaaaatgtttgttgttgcaaaccactgaaaactgagggtcattggctgctgcagcaaaagctaagtaattcaatgctgaagaagatatttggctattcagtctttaaatatcaaagccaaagctataaatgaatctgaaaagcaggtttgcccagataatgaggttgaagctgatgttggtacatcattaggcatagatgggcatgcagagcctcacaggcaatggaaagggctttgaaacctatcaaaatgacctagacaggagaaggggtgatataatcatatttgggttttggcaagatcaccctggctacagcatgaacagtctacagaaagcaagaaatggcataagaagaatagttaggctaatgatgtagttcagaggataatagttgtggaaaaataagtgaatagatttgagacatatttaggagacagaattgataggacttggtgatcaattctatatggaaggggtgagaaagaggaggatgtctgggattactctaggacttctagctttcctagttggttggagaggagtattaatcactgagatataaagaacactagagggaatcaggttcgggaggggaaaatcaaatgtttaattttggatacattaatatttggattttggggtgtcattgagccaaccagatataaagttttggagctatgaaaaaatatgaactggagatataaatttgggagccagctttatatgggagattaactaaccatgggtatgtatgattaagaaagagagttgggcaagagcatacagcaagaagagaagaggggcctaggaccaagttttaagaaagtccaacatttaatgattgtattgaggaggataagccagtgtaagatatcaccagaaatatgaagcccacagcaaagccttcgtgaattgttactaccatgtatttctgaggtgtttactatgagcttggggcactgtgctaagtgttagtggtataaattagtttctgccctcaagaagcccacagcctaaagggagagacagaaagtgtaaacaatgatcatatccgaataccacacactgttattagtatatcaacaggatgtttctgaaggatgtgaaatctgagttgacaccaaaggacacgctggaattggctaaatagggaactcagggagtggggtggtggattttcaggtagagggaccagcctttttgagtgtatagagggatgagactgcatgacacatttgcagaaccagctagagctaaggatgagtgtgagaaggtgttaggggtcatagctggagaagcacacaggagacagaacatgaagggccttatatgcaagaatcaggacttcatcctctgggcagccaggtcaattagagggagctgggccagtgtgcaatttggaggcaaaatttggagcatggtgttatgcagctaggcagggtgtttgttcttcagtttaatagccaccaaaatatcctcttcacaaaactgataaaagagcacgaggtcacagagtgagaagggcagaactgcgtccaggtctaagggttttgagtgccattccagcgagctcccaaagatacatggtttttctcactcagagattgcttcaataacagacttggtttgggttatcttttgtcaaaactggatttttttttataaaagattttagtaacggtctgagttttatgacaggcttatctgatagaacaaaatatctaccagcctgtgagaaagtgtccaaaattatgttctaaatgcataatattatctaatttatccacaatctcattactcttttctatctgcctctcctcactcttaccactgcccacttttctaaaagaaaactaaagcttccatatttgtaaaaggtgcttaaatatatagtcatttatgagacttctaaacagtagctgtttaagtttagcccaaataagagttttctctcaattataagttatcatttattgtatctgctgagtttggtctgctttttcatctttatcaaatttaaaactgaggagaaatcagggaacaagttgttattttttcagcactttgacttattcacatttaatctaatgcattttcaagctggaaagattttttactcatggccttttcccagattttttcctttgcaaaaaatagaatcaactcaacacccagggaggtgagttccattaattatccttttcagatagaaaataagtagctgggaggaaaatgggaattcaaagccatgttattttactctgttaatggcagtaagcaactccagaatgaagggtcatattgaagaaacttttaagcagtttacaaacagaatgtggtctgttaatgtttacactgctcaggaggagaggagcttttgccagaaccccttagtctttggccatgtttgaatgttgcacagaatgggcaagatttccatgtgacatgaattgattttctctatcaagagtggaattcaacctttctgtctaaactactttcaaatcctacctcttcagtgatagtttgtcatccttttgctagacaattttttaaaaatctcatcacaaatcctatggagaaaatatctttggtgaaaatcttttattgtatatatttaaggtgtacaaatgatgttttgacatccattacatagtgaaatgattgctacagtcatgcaaattaaatatgcatttcctcacataattaccctcttttgcagtaagagcacctgaaatctactcttagaaaatttccagtattcaatacagcattattaactatagaacttatgctgtacatgagatctctagatttatacatcttatgtagctgcaactttgtagctttgaccaacatcctcatttcttccacctccatccccctgtgtgtttgacttttttagcttccacatatgagattacgcagtatttttctttctgtgtctggtttgtttcacttagcataataccctccgggttcatccattttgtcataaatagcaggcttttatcaaaaaggcaagggataacaaatgttgatgagggtatggaggaaaggaaaccctggtacattgttggtgggaatgtaaattagtaccccattttggaaaatagtgtatattcctcaaaatattaagaatacgatgaccatatgatgcagagattcttcttctgggtaaatacccaaaggaaatgaaatcagtatctcgaagagatatctgcactctcatgttcactgaaacattattctctggtgaaaattaatgcaaaaaatattttagttactgcagtagcaaagagattcatgagtttagcctattgcacatagctgaagaaatcaaggaagaatgtttcgcattgccataccagggtaaaaagtgattgtgtgtatatttctgtatataaagtattatgtaattgtatatttatacttatctatctctttcattaggataaaagccccacgagagtggggactttgtctatcttgtccacttctgaatccctgaagcacaaaacaaattattggcacattagttgaatgaatgaatggcattgcacacttacaatctattttgtttaacttacaaacagcaaaaatgctaccacaattctgaattttgattaaatagtgtttcaaaatcacagatctgttttaaagattaaatgaggatttctgctttaaaaatgtatgtttagatagaaaaatagtgtaagcaaagataagtgaaagtgcttaacccagggtgggaaactcaatgacatttaagttgactttaagtctaaagataggtttgaggaggagtggatgttttccccaaaccagcctcaaattggaccttaagtggtccacatgcaaaacagttccttctctattgttctgaagggggtgttttcttgggagtatagactagtcatcttgcaggcagctaacagactacattgttctcatcagatggtagtattgagcttgccagaaaattttacttacagtggggaactcctaaggctgaaacattttatctgcaggtccaaaaaatcttgacctggtgcacacagcagggtaggtaaggaaaggaaccatcatctacggagaacctaccatatgaacagctctaccagagacctcatttgattcctactttagctttataataaaagttaacattcattgggtacttattgtcctaagtactttgcatggattaactcaataattcctcacaacacaaggatgtatttttgtttccaccatttgacagaagaggacatccaggtacagggaagttaaacatgctcaaggttacacaatgtgtaagtggtggagccagtatgaaaacctacgtggtgtgggttccagtgtccaggcttggaactgcctctgtaagagaaggattactatcctcattatttgctaaggctcaataaataaagtgacttccaaggtcacattaacagagctgtctgactccaaagctgaagatgctttacttttccttatattgttctacttcaatctcacctcaataaaaataaatctagcagctaacatttatcaaatacttactacatggcagacattattttaagtgcttcatgtgaattatctcatttaatcaacatagtaacactttgaggtggggcttttattagcccccttctgtagatgaaggtattaaggttgagaggagtcaagtaacttattaaggtgacacagtaaattggtagaatcaggatttaaaacttggtttatttgcccaatgagccgaagctcttatccattctaccacaatatttgcctagaaatattgcccctccttcccaatagtagtccctcccatctctcttatttttgctgaagtcttagtacaaggctgagactactgtttgtccttatgttgctgggtcttccaggtcttcaaggggaaggttgtaatagtaaagtcactcccaaattcaaatattgtaaatattgtaccctttggagtcaggaatgaagtacatgctcaccatcaactcagatttttgtcaagaggaatgagactgatggaaataatcaatagcttttttaaaaaaacacacttattgagaaataattcatataccatttagcacacccatttaaaatgtatacttcaatggtttccagtacattcagagttggacaaccaggatgacaatctaattttataatattttcatcatccccaaaagaaaccccatgcctattgcccctgagcccccagccttgacaaccactaatctgctttctacctttatagatttgcctgtttgggacatttcatataaattaaatcatacaatatgtggtcttttgtgattggctcctttcacttagcatattttcaaggttcatcaatgttacatgtatcagtattttatccatttttatggctaaataataccctactgtatgcatatatcaaagtttgtttatccattcctcagtggatggacatttgggtcatttccactttttggctattatgagtaatgccactttaaacattcatgttcacgcttttgtttgaacacctgtttccaattctcttgggtatatacctagggatggaattgctaagtcatgtggaaattctatgtttaacatttggagaaactgccaagctgtttttcaatgaggttgcatcaatttacatccccatcagcaatgtatgagtgttccaatttcttcatttcctcaccaacacttgttattgtttggctttttgatatagctattctagtgggtatgaagtggtatctcattgtggtcttgatttgcatttccctaatgaatagtagtgcttgagcatctttccctgtgcttgctagccagttgcatattgctataagctgaatgtttgtgtcctctccaaactcacatgctgaagccctaatccccaatgtgatggcatatggaggtggggcctttgagaggtaaattggtttagatgaagtcacaagagtaggcattcataatgaaattataatgcccttataagaaggggaagagaccagatccctttcttttttttgagacagaatctcgctcagtcacccaggctggagtgcagtggctcaatctctgctcactgcaagctccgcctcctgggttcacgccattctcctgcctcagcctcccgactagctgggactacaggcacctgccaccatgccctgctaatttttttgtattttttttagtagagatggggtttcaccgtgttagccaggatggttgcgatctcctgacctcctgatccgcccgccacggcctcccaaagtgctgggattacaggcgtgagccaccgcgcctggccgagaccagatccctttctgtctttgctgaggacacagccacaaggtagccatctgcaaaccataaagtgggccctcacaaggcattgaatctgctggcatcttgctctcagatttcccagtctccaggactgtgagaaataaatgttatttaagacaatcagtctatggtagtatgttatagcaacccaagcatactaaaacacatattttctttgaagaaatgtctattacaatctgttaacccatttttaattggttatttttatcattgagttgtaagagtccttttcatattttgaagtatctgatatgcaaatattttctcctaatattatgttgcttgtcttttcacttttttatatggtatatttttagcacaaaagtttttaattttgatttactccaatttatttctatttcttgtatcacttgtgcaaatcgtcttaacattaggaagacttattacaatgttttcttctaagaattttataattttgactcttacattctataatccattttgagttgattcttgcatgtgatttaaggaaaacttcattttttcccatgtagatacccagttgtctcagcatcatttgttaaaaaactattctctcctcaatttctcttgggacccttgttgaaattaactaaccatatacatgaggatttatttctggactctcaatttaattccatttatttatacacctacccttgtgtctgtaccacactgtcttgattactgtagttttgcagtaagttttgaagttgggatgtatgagccctccaactgttctttttaaagattgttttgactgttccaggtcccttgtaattccatatgaattttagaatcagcttgtaaacttacacaaggaagccactggaattctgataagcactggattgaatctgtagatcaatttggggcacatttcatcttaacaatactaagtcttccaatccatgaacatggagtgtctttccatttattttgatcttctctaatctctttcaacaatgttttatagttttcagtgtaaaagtttcgcacttcttttgttaaattattcctaagtacttttttctttttgatgctattgtaaatggaactgttttctttctttctttctttctttcttttctttctttctttctttctttctttctttctttctttttgagacaaagtctcactctgttgcccaggatggagtgcagtggtgtggtctcagctcactgcaatctctgccttccaggttcaagcaattctcctgcctcagcctcccgagtagctgggactactggtgcgtgccaccacacctggctaattttttgtatttttagtagagatagggtttcaccgtgttagccaggatggtcttgatctcctgacctcgtgatccacctgcctcggcctcccaaagtgctgggatttcaggcgtgagccaccatgcccggccggaactgttttcttaataacattttcggattgttcatttgatcttgtgttttaaccttgtatcctgcaactttcctaaattcatccaggcaggtagttgtgagcaacacgagaagagcaagaatatgcctgggataaggaaaaaatgaattgagtagatcaggactataataatggttaccatgtactgaatatgttttcaacaagtcagtacttcccatgctgtaatatgttcatgaatctcctggaaatctagttaaaattcagactgctatcactgggtttggggtgggcctgggattctgcctaataacttcttggattgttagtggcttttatttattattttcaagttacaataactgcaagcaagataatactgttcccattttacagataagaaaatgacctcagaagttgagctagtagcccaggttcattgaataagtggcagaaccaggatttgaacacagttcattctaatgccaaagctggactctttctactctaccacaatggatatcttgagtagaaggaggatagttggaatgtgaacagaatatggatcacgaaaaaagaaagcttttcaatgtcagagttgcttcctggaatacatttgagtctaatctttgaggttgccttggagagcagatcaccaaggcccttgctttccagggagctgagcatgaaggtgtgagattggactatcagctagaagtaagatgaaaatactagacagaattcaagattggaagaagtctagaaagaatggcttaccttcgatcaggctagactccagaactagactctgtatactgcttaggtctatacctgagattacacctattgttgactttttctgcattctaaacatggggttagactggatgtgatgttgccactgagtaaccagagaggaagaaatatatcagtgagctaaagggcagggctgtgatcctgagatccttctgagtagaaaaataccatgcttcaatactgtgataacaacagaaataaccaatggcttaaactctgtaccccctactcaggatggtcttgaaatagatgtctaaaagctgttcccctaaaaaggctatggcagatcctgctatttaactggggatgatgaatggtatagcatcaataccatccctcagaggccagggtaagggtttagggatgtgggtaagggtctggtcatatgtttatctgtgaaggactatggataggtgaccaaattcctttccagtacttttcagcagaatctttagacttccatcacctgagttaaaacacatgagatttttttttgtccttagcaccttttattgaaatatgacccttgatgacaatctggcaggcatatctatgtcagccaagaagggagtggtggaggacacaaatgcagaaacaacaagatttggaaaaagaatagcttcacatgggatagatgacccccaacagctgtacaaccaacactggttcttcatctatagaaactgtcccctgccccacccccccaaaaagatctactaatcttcaaataatataatatgctgttgcagaaatattattggcatagacgactcctctggcaaagctccaaatgggtggaagtggccagaaatgggcccagcttcctccatctggggcttgctactggcagagcagcactgtcagggagggtcgggttcaggatgtggctctggtgtgcctgggcagctttatggcacatgaggttaaatggaaaacagaacctgaacctaaccttgaaggaggctttttatcttttcacctctccttttctttgcttccaatttcttcctttctagggctttattttcagtgtctctgtcttattctgtcagattctacttgggcatttacagctatatcctggttgagtctccagctgtgggactcaggaagattcaattatccagagccctgggaggtggcaggaggggttggggggacatgtgatagtaactcatgcactgacttctctatcagccatcatgcttgcctattacccatgggggcctgtataagtatttgacgggagacagcagaagttaagactgataactgtctttggggatctcccttggcctgccttccaaactgctactcactggcaggccttggaggagggctgagcccaggaactgagaacaggggagagagactgcatctcaagtaatactggcagtgttgcagcaccgtcacacacaatgagactgccctggcaggagtgtggcacgccagtgtctgtttagcagttcacctttatctaccaagcttcactgctagatatacttttggggttattttttaaatgctttggcaactttccctccatgtgaaaatgagcatccttgtgttctgattctaactctagaaactaatttgagatgggattaagaacaaaaataacagagttaatagtatttttggtgtcataaacttaaggtacaaccaatcacatgctgactagaaaaactcaagactatggccatagtgtccaggtaagtgaccgttcttttccctaggcccatattcccaaaaaggtgctctagcccacaaattctgagaatgatgaaacatatcagcctcatcctcccaatacaggacatctcaatttgctcattgtttgtcctagagcctgctcagaagaaaagatgacaactatggcctccattgaaagcactcccctaccttctcaatcttggctggcttgtgtaagcctagcccctgcaagccaccagccttcctgaataaagtagaatcttccactggaggggagaatggcagggttgccattctaacagtgtttctggcagcagtactaagagcaaacccagagctccacagaaaggcttaccccaccccctaccccaggacaccctgctggccaagattctcccattgttttcaaatacaatgaagaggaaatggaagctagtgacaagtatttgtaacagcagcaaaagttccttggcaaattctttggttgaatgagacatccctgctgctacagttgaccttcaaggaccctgaggaactcagcagtaactagaagagatgccaggccttggctgggttgtgtgataccaaggattggccccagttagtgaggaacagggagctaagctggataacagggcagcatttggccataacccccttcttgccatcgtccacctgagggctgcttttccagcatagaaactagctactggtgtcagggccttggcaacagcagcagttttagttgtttgtatgcctaagatcctggctgggtcttcaattgctctggggagctggctctggctggagctcccagctaccttgagttttggttcccttgagccaggccacaggctgagaaagcaatggttagaggagttccttctgagctcacctctactgatcccatagcttggagatggtagagaaatgactgaacctttctccatttcaggagatttctttggtttcaaaaagaaatcagtaagaaaaacttaaaccctgctggggaatgctaaactcaagtcacttagactttaagggaagcacaaggccaggccacagtagggaggctctgagttcaaggggaaaactccttcctagacatcggtagctatggtgggaacaattcaacgccttggcacttgcttacctagccacggtggattcaggctgatctgcagaaaatgctttccttctgggctaacttttccctctccaacttccctcttctcgccttattagttaaaaaagaaaaaaataatcaaaacataaaaataaataaaatcaaaaggccatttaaaatataacaataagaaccccctcccccaataatgaaacctacatctagaagtcagttttagtagagctattaatggcccatatggtgaagccctggggtaggcacctgcggtaacccccagcaatgtaaaggaaagatgaaacaagaggtggtaggaccaaagtcttaggacaggaagagggtcacactagccagggctaagagtaggcctcttcccctgaacttgctgctgggaaaggtaagggtagagcctatttaaacctggttccttcctaaggggcacctgggggtactcaacctttgcttgcatttttttcagtgtaattcctccctctgtgctttcccctgcaaagcttgggtgaggccctgaaactggtgccaggtgaatgccctcaaggcagccagctctctgtgagaaatggctggccacaagccctggggcagagtagagctgcaaggcagattccctctgagcctttagaggctgttgatgatatgggtgggtgatgagtacttgatgtctttggtgtcctagtacaaagcagaatgaaggcacttccttggttctctgtgcagcaagtacttgcccttggcaactgtgggaaggagagtgtggttctaagatcacaccttgctgcagctcccttgggtagaagcttgtggcttccccagggtctcctagctggttaggaccactgctagggaaggggtagtgagagacatccagggtagagggctggaacaaactgctaattgctatctacttgctgagaaactgctaacaaagaagattgaaagcacttcccacatggctgggcagggatgctgtggcagagtgctggtagaattagaaattgctgggccccaggagtagactctccctgagacatttgagttgctcttccccgagcttgatcttctcctccagctctcgctgttcaatgatgagagcagatttcatcttgacaaagtgctggtaatcttggagctggtcctgaggcaggtagcgggagaccatgccaaacaccaacttctcccggcggtccacgtgctccttcagctccttggcatctgccaactgccccgtcagctgctgcttcttctctatcagtaccaactggggaagcagaggaccaagtaagggctctctcaattaccaggcatctgtccaacagtgctgcctagcagtactccaccagagatgctgccacaaagcagctatacattctgctaattagtcagtcctagattttctgccctgaagtctacctccatgcaaaagcctttgtttcctgtagcaggagggtaaacatgacaacaattctggataggggatgtgaaattacctctttccatctctttaacgctgtcttcaatgtagggaccaccactgggcttggggtggaggaaggctctgacaaagccagcctgtgtccctttcacctggtgaacaactgtcactgtggaggtgctttctgtatgatgtgtgtgtctgtgtgagtggatatgtgtgagtgtatgtgtctgtgtatgtatgtatatgtatgtagatatgtgcctcttgttgtggattcaaaggtatatccaaagccacctgtatagggaaaggtgatgcaattttggttcaggagtatatgcatagtgacccaacctgtgaaactgacagctttccaatctcaaatacttgatgagacctccccctccaactctagagtgaggcaaaactgctgctgctactactactactgggagctagcattgattcagtgtttaccctgtcccaggccctgttttatgtaattaacataaactaatttaattctcacaataatcccataaggcaggtagtatgctcacctcattttacaggtgaagagattgaggcagagtgacgttatgtaagttgtccacagtcacacagctaataaatggtagggcaagaatttcagggcacttaaaagccagtgttcacactcttatttttttattttattattattattttttttgagacagggtcttgctctgtcacccaggctggagtgcagtggcacaatctttgctcacggcagtctccgcctcccaagctcaagcaaaccttccacctcagcctccggagtagctgggattataggcatgcgccaccctgccagactaatttttgtatttttagtagagatggggattcactaagttgcccaggttggtctcaaactcctggactgaagcaatctgcccgctttggcctcccaaagtactgggattacagacatgagccaccgtgcccatcctcagtgctcacatgcttttaatcccatgctctactgtttcctatagtagcccaacttgaaagagggagccctgagaagaaacaaatggtatttccctctacccacaccccacagaccccaactctaccttctcctggttggcctctgaatcgatgctgttcagagcattctccacccgggccagtcgtccagagagtgacagcaacaggttgaccactttgtccaggtccccaacaaacaagtggtacttttcaaattcattggatttgcagacggcttttaagttggcctccacctcctccccaagggcagaattggcattgatgtcctctagcagccctcgctgggcctcccgcaagacagaaagttttctgctgatgctttcgataagctgtatctaggggaattaaacaggagaagacaaaggatgagaatggggatcaacagaaactgatttgtgcctgtaacctctgttttggaatccaaggaacagatggtgggctctatcctagtcactggaaacaaaggaaacttgggcaagtcatgagcaactccagtcttttgggcaagcaccttctatccgtctggtagggatctccatgtcaccaccaaactttttggcattgggtaagtggtatccatgcactaaacttcatttaccagatgcaacttaataaatacttgctggcactttgttttttttttgagatggagtctcactctgttgcccaggctggagtgcagtggcacgatctcagctcactgcaacctccgcctctcaggttcaagcgagtcttgcgtctcggcctcctaagtagctgaggttacaggtgcatgtcatggatgccaggctaattttgtgtgtgtgtttgtgtgtgtgtgtgtgtgtgtgtgtgtacttttagtagagatggggtttcatgatgttggccaggctgacctcaagtgatcagcccccctcagccttccaaaatgctgggatcacaggtgtgagcctctgcacccagtcccttcctgggacgatttaataaataggagctacagtccttttgagagcctaggttggaaaagcatttgcactaaggtatttgcctatcacttcattcattctccttcaatccatttaagtacctctcaagttcatgacactatgctagatctttgcttccttagcttggcttttgaggccttttggataagactgtgagttctggagttataacgactgggtttgatttatagctttgccacttcgtagctgtgggaccttgggtgacttgacattattgagcttcactttctttatctgtagaatggggataattgctttacccactgcattgagtcataataaggagtcaatgagattatgcatgcaaagtgtttggcccatagtaagtgctgcgtaaaagctaggctgctattatttgttactcagtctggccccaccttgccattctaatgtccctcctcagagcctttcagaattagctcctcattctcctctgtgttcacaacactcattcttgtgttcctgagtagcttatgcagttccacctactctttatctctttcttcattttgattattcctaaatttcttcaggggacagctctgcccctcccctccctcacaggaagccctcctctgtaagtcttctctcagtgatctttttttgtccgagcttttaagtattttagaattagaaccctatagtgtaacttgaagttcctcactttctattccttgtgtgtgtctgatctctcacctgctaatgattgtaagtttcttaagggaagtgctgtctgtgtcttctgatttgtctcccctataggtgagtacagtcacagggaagtacagcaaagttttagagtcggagacatctggattccaattccacctccaaactctatggccttaggatagatacctaatcccacttctgtttcctcatctgtaaagtggacacctccccaactccagagattttctgatgggtaaatgaaaccacataagtaaaagacttagtattatgactggcacttaaatgctcaatgcatgcttactaatgttattattattattaaattagttctacaacatactccaaactaatagatacttgtctagctgcaaggttatgacaagaatggccctgtcccaggctgcccatagcctctgtagacagtactgctttgtggttaagagcacagagactccagtgccagactaccagagtttgaactcctgctctgctggaaagtagtggtattatatacgaccttgagcaaattactcaacctctctgcacgtcaatttccacatctaaaaaataagataacaataggacctacctcatagagttgttatgagaattaaataagttaacacatgttacatgtttagaatagtatcttgttcataggagtatgcttcagtgtatgttttaatcttattctagcccaagcactgggcccataggtttgtagttttctggaatgtattcccctctagtaatttaattagagatgtccaaagtgaccaagactaagaaagcctcctccaggttccaagacctgttgtcatattttagaactcttcaaaagtcaggagatcaccatgatctcagtctgaagtataataggtttgcatttggggaaagttccaaaacccactgagaactggggatcagtgatatgaataaggcaacacaattagatgaagaggctgtcagttatattcccaccatctgctctcccaaataaaagtcaatgctggggacaaaggatggctaggggccatctagaaaatgacccacttggaaaatcaccttcttaccccagttcccaagctccagggatagatggaaggataaaagtggagagagccctttacttcttggaacttgggctctacaacctgaacctcagtcctggggaagtgtgatggatagagttgtggagtcatcacagatccagccagagctgagttgctttttctgggacatcgcaaattggtgacattcctcacctttcttcctcagagacaaaaactgtcatagcccacccacaatcactttagttcactttctgtcgttctgtgctctgccatttctgatcatctctctcttttcctggtcagacttctaggtttgcccctgcagaggccaggccctgagtaagctaggagtacccctgctcggggaacatggaatccaaggaagcagacatctgcatcagtaaaacttcaacaccaccatgcttccaattcttcccctgacattttgcttcagataggaaattggaggaaggactcttgcaaatggccctgtaacttcctacgggtcatatcctgaaagaaatatgggcagaacaatttacattgagtttagatgtccacaaagaaggtaaattgagcctttgaggttgccatgacaaccctatttgcttatgaaatacaataggtaagtgcagggaggggaaagtgattccaagaattggattagaaaaccagactagtggtacttagacaaagaaaggaaagctttggaacgacaacaacatcatcatctccacttaactattttgtacttttaagacataattgactatccttgcaaataaatactaaagtttgccagcctataagttgtccttattttacttagtctcttctgtctcccacaaagttgcacaaagaataaaaatcaatggcactgccattggttagaggagcccactggcagaaactctgatgtgccctgggtagtgagttacttacaaggctggcttaattcagagagacagcatgtactgtacagtagaaattcagacagtcttgacttcaagtgctggatctaccatttagtctgtaatccctgggcaaattcgtcccttcaactagtaaaaaagggatagtaatatctgccttgttgggctgttcttttcttttcttcttttttttttttttgagactgagtttcactcttggttgcccaggctggagtgcagtggcgcgatctcggctcactgcaacctccgcctcccgggttcaagcaattctcctgtctcagcctcccgagcagctgagattacaggtgcccaccaccacgcctggctaatttttgtatttttagtagagacggggtttcaccatgttggccaggctgttctcaaactcctgacctcaggtgatccacccaccttggcctcccaaagtgctgggattacaggcgggagccaccgtgcccagcccttgttgggttgttctaaggatcacagagacaataatgatgattatgattgttattattattattgactggatcaaaaatagacaggacttggatctgtgagaaatccagagaggctgtatggtttccatactgaaaatatgggaatgcgagatgttctagagagtgtagaaggctggtcatcctccagatacattcaagctaaattctgaaaatctctaggacacatcaaaaaactttacctttttttgagccagttcatggtcaacttcctcctctcctaggccaatctctgccatctcaggttggtctttcagtttgttcagcagctctgccttggccacagaaatattgtaataagctgagtaagaggtagggattcctggggcccctgaaggaggcgaaaagtgctgaaactcttgtctgtggaaacaaagaatgaccatttgagcacctctgttgagaggctgctgacatttctgcttcttaatttctccatctgaaaaatggaaccctgcttcaccaaggagttgaaaaaaatggagaaggcactgttcaaatgtaaacaggccacatgaaggcaaactggagttaagtaaaggtaagttttaagaacttagaaggctatttccatgcccctgacttcatcggctagggagacttctttcgagataatttggtttggtcattaacactcaattaaaatccagaaaacctggcaggccttctgatcatcatccctttggtgcatgaccccagtatgtggatcccaaagtaggggctaggtggtagagaagtatctgagaccttatctattggttctccaagcctgttggcctccctcagacctacccctggatctcaacccatcctggctctatctagtcttcttgcttacaaaggcaccctgtggctttcctggacactctcatcatttttttcttttccaatgccactcctacttgaaatggaccctctgctgcagatctcccacagcaaagaggtcacccatgacctcaacagtggtcaccatgttggaggctgcagttagcaccctgccagggacttgtcaccgcccaccacatctctcatgaactcttcagacattgcctgctgtagggcaggacttcagcctgaaaagggatagcatctctccacttctggcatattcccaatggctcctgcctcctccatggttgtagaatgaaatggggaaaaaaatggaaccagtggcacccaggggcttgacaagtatagcaacagaccctgttgtcttgggttcaccaaagcctgtggggctgaggcattgcttctcagagccccagcccatgaaatagaacttctcaggaaaaaaagtagttctggttccatgctggcttgggtttggcctcttctgccatcaaagcttccagtctggtgtgaggaaggaagtagagagaaatgctacaatgttaggtctcagcgatggaggggcaaataattttgcccgtggtttatgctagggggtggcccgccctcactatattctcattgcctgctagccactcccatcctccacctgtctgtgtcactaccccttcgctaacctctagctgtttgaaagggaaaataggagaaactcattagtcatttttgcagctatttgcagttcttaaaggtcaaaaataatggttaaaaggctccacagctatttactgattcatgctatgctgtctcctaattcatcacacaaaagaaagttgggcccgccaatattttttatcctaggtaaattcatttatatgtaagtttcaagcttgtaacactgataaaagaacaatactagctaacatgcacaccatacttaccatgccccagaaaccatcctaagatagatacatgcacacataggtatatacatatataattgaatgctcatgaaaaccattatacagataaggaacatgaggcaacatgaggtacagtgacttcctcaaggtcaccagacattaaatgacagacctgcaatttgcacctggacaacctgactctagaatctgtgcttcaagccgctatgctatactgccaaagggacaacttgagatcatataaaagcctacatgtaaggaattttctggctggagtatatctatgttagcagataatggagaatattctggagggaatatgaaggtctgaacttagggaattcctatctacaagaaaaatatttagggtatgtgtgaaagttctgtgtcagaaggtgttataaaggaaaaaaaggatgtgctaattggagactcagttccccagcatacacatccctgcatcatattatagtatatcacattaggcactatattctagggatcctttccttatcacctccattaatagggaagtgattataggtggtctatgtagtaaacatcaaagcaaaaagcagattcctttcacagagcactgagaggaaatgcatagagtccataaagcaagctatacctatacctgaatcagttattagacttaaataatacttaattattccactagctggcttctgtgtgtatcccagcattttttaacagaacagtatgtaggttataaaggtactagagtttaacttggctgaaattaggatatctttgtttgcattttagattcaaaatattatgcatctatatgtcccttacaaaatcttaaagctgcttccttctggctaggacactgtcctctcctagggtctggaatagaatcttcttcaagagcccagagatcgtgggatgatatagcaagcatagtgagctacctgagatcttgtgataaagttactttatctccctgggccttgcttttttcatctaagaaatggagaagatgaatggtaactatttcataggtttattttcatgattaaatcaatcattacccaaagtgcttagaacaatgcagggcacatagtaagcaatcaaaaaaattagctattttgggaatgatgctgttccttaaatctccatcactcaaaggagcatctaattgattttgtagtcacaagcagagctgtgtgcaaacaaatgttttcccttacatcctagagtcattaaaaataaatctctggagcaagttacaagatctctagtaatagtgatttctttctgtctggccaaggtgccaaggcaaagggagctacacaaagaaggaagaaccagggcttgtaactgctgcctctggtacaccttgccctacaggagagaagaggaccctgtgactcctggcctatggaaagaacaagatctctctgggagaggctgcctaggaaggcaaaataagcatgggctttggagtcagacagctctggctttgaatgtttgctgtgtaacttggaattagttagtttcctcatctgtcaaatggggataataatggctaatagggctattgggaggattaaatgaaatagatacataatgtctggcagtgtctggtatataagaaatacttaataaatgttcatccattcatttatttgttctttcttcttaaatatttgttaagtgcctactattgggaggtcattttcccttttccctgctatgatagataacaatcacaggtatttttcacaaaatgttttctaattacaatgagaatgctccccaggtagaagaacagcttgagaagcagccacatgggatctaatgaaggattcttttttttttttttaattatactttaaattttagggtacatgtgcacattgtgcaggttagttacatatgtatacatgtgccatgctggtgcgctgcacccactaactcatcatctagcattaggtatgtctcccaatgctatccctcccccctccccccctcatgaaggattcttaacagtgcctgggagccaggccctgtaaatgctgtgcttatggcatcttgggctggaaaactgatcaactagctccacatagacaagtcacagatttgtctgacaataaaagacatgataacaaggtacttctaaccgcaacaagtctcaggcaaattcctgctataaagagagttaaggaaagcacttataagccacctgcctcccgaacctcagccccagcagagagtgggctgagctctccacaggagagcaggtggagctgctgacagccagagcactgagcaataatagcaatgatggtcctggggcttttgctttggagcaaaagaaattaaaaaaaaaaacccaaccatgcactatagggcatgcagatgacaactggctcagtggagtgaacaaacactggcagtcctgctgccagaacacactcttgctttggcctccctgcccaggcagctcaccctgtcaactaccacctattacacacccacatgaatgcaaagaggcaggtaaacaaggagggggagaaagtggaagagaaaaagaatgtccttatctattgtaaggaattatcaaggcatgaagcacccagccccaggaatacctttgatgctggtggttgtggggggacgagtttagaagcccaggctacttgtcctagagcagaggcaggtcaggttgtgagctggcctcttattctggagggcaagcagaagagaaggcaggaaaagtgcctgagccaggtttctgggaaagacctagtataggcaacaagtgttcaatgcctttgggatcaggggccagaaattgatggataccatgaagacacactaaggaaaagtatagtactttaataaagatatttagggataagaacatgatatttactgagcatgtactatgtgctaagcatggagctatatcctttatgtagattatcttaatattcataacaatcatgtgaagcaagtatcattatacccattttccaggtaagaaaactgaggctgggagcagtttaactggccagcctgaggtcatccagttagtaaatagtggaggtaaaattcaaacttgtgctgcctgcctcttcagagacctagtatctttcatatgtacttacttggcggattcagtggcttcctgtcccgatgtcctccaaagcccaccaatgccatagtagcaagggggctgagcctgctcaggttgagatcccaagtgaccccttattggaggcaagaaatcactggaatggagtgcaaaggattcttgctctgctgggacactttgtgaaccctgtctcgagccctccaggtggccaaagctgaggggttgtggctgctctaggacctcctcaggattgagagcacaggaaccagaggtttctgaactgaaatactggggtggcagctcctcttcctcctcctctgcctcctcctcctcctcttcctcttcctcttcttcttcttcttcctcctcctcctcctcctcctgttgcttctgctgctgctgttgctgcttctgctgctgggctgcacgaaagagcctgtacttctcccagttgggaggaggagggcgaggaggaggaaaggccttcttcctggctccgagaagatccgactgggtctcatcacctttgctaaagagctccctcctatgctgcccccaggcccgggtgctttggggcgccaagctgatgtgactctctgagaaggcacggctgcgcagtgggtggggcatggaggcaagggagctcccctcctcataaactgaagtttcctctgattttttcaaagcatgtttgaagtctccaaggaggtcaagagaagaaattgctcggtagcttgacaagtccagtgctgggttctcaaggcaaggatggaaaggggttgcccatgaaaagctagtcttggaatgagccatttccctgcaaaacatcagatgagtactgagaaaaacaagcaagttgcagataggcccatattttggatgacaacatttatataaaatttaaaatgtccacaaaacaatgtagtatgtgtagtaaatgtaataatagtaataataatattataataatgatagctaacacttactgagcacacactaaatactaggcactgtttaagtggtttccatgtcttcacttatctaatcctcacaataaccccaggaggtagctattactattgcactgattttacagttggggaaactgaggcatagagcatttaagtaacttgcctggggtcataaagctagtatgtggtagagctaggatttgaacttgaacagtttagctccaaagtctggatatacacatactaccccagtctgtttataggagtcagattgcatgtgctgttttctggggcttacaagcctggttatcctgcctcatctgttgtttttgtttgtttttcattataaaaatgttgaatatttagaaatgtacagagattgattgccataatacccatgttcctacctatcacccagacttagtaagtttgaatactttgccatttatgttttatgactgtttcttaagaaataatacccttcacataactctccacttccattcccctattgcctctctagatgcaacctgtattatgaattagatatatatactttctgtgtttttatacttgtaacaaaaaacaccacacaggtcattcatagttatctgctattttggatttaaaatatctccttctggccagacacagtggcttatgcctgtaatcccagcactttgagaggctgaggtgtgtagatcacttgtgtccaggagttcaagactagcctaggcaacatagcaagaccctgtctctaaattttttttttaattagctgtgcatgatggtgcgtgcctttagtcccagctacatgggaggctgagatgggaagacagcttgagactgggaggtcgaggctacagtgagccatcattgcaccactgtactccagctggggtgacagagtaagaccttgtctcaaaaaaaaaaatatcctaatgcaattccaatcagaattctcaataggaatttttaaactacatttaactacagaatttttagaaaattaacttgtaataaaagcaggatataatattaaagagtattctgctacagaagaaatggggaagggggtaagtaagggataaagtatattataaaataattgtaattgaaactgtgttattgatcaacaaaacagaatagaaagttcagaaacaaagcagactacctataaaaacatcatatacataatcttcccccaaaaaggagataaagaaatattatttaataaatctttttgagataactgcaaagcagtgctttttggagctacatcatatattatataccaaaataaattccagatcaagagtcatggatatgtgtgtgtgtgtgtgtgtgtgtgtgtataattttaatatattatatatgttatatgtgtatatatatgtgtatatattatgcacatatataacataagaaaaacctatcagaaaattaaaaagactatcattgtgaggtgaaataagattctcataagcaatagaagaaaacctccaaataagtccaggtttatttgaatttacataaaaattcaaacttctgtataataaacactgactaaagttaaaagacatctctttagcctcagagtataaagagttaagccctctaaaccacaagatctggtttcctgctgtagcctgtgagcaatcagcatcatgctaagtcctgcccagtgacaggaaattccaggggttcaattaaatcatcatacagaatatccattcaataatcatgatgaagattggaaatagttctttaaaaaataataatacacataataatagccaaattcagacagaatggaagacaaaatgtccttaattctcctcttatccctcccccattctggtcagctcaccactcatgtggatcagaaattcatatccagacatacccactatcttctcatttgggcctttgcacacttatagatcattaagattataacaatcccttttgtgcaaactgttccacctggcatattctctctctctctctctctcacacacacacacacacacacacacacacacagtgatggacaagtggaaagtaaaaaaatgacaaacgtgtaccaggcagagaagcctttcctgactactttatcaaaaatagagacaacttacatttaattatccttattctacttcattctttgagtattcatcttcatccccacctgatatcatatcacatatctatttttacttgattattttctgctccaatctctaactaaaatgtaagctccatgagggcaggatcttgtctgtctcattcataggtttctagtgcctggcacacagtaagtgttcaataaatatgtttaacaaaggaattaaggtcaaaattaaagaaaaaataaattatgatactcatttcatacataagttgaattaaaggcaaaatgcaataaataagacaaagaagggcactataatgttaacaactagaacacatgatggtctacctcctctgatcttttatgcaccaaaaaacatagcataaaaattcttaaagcaaaatctatagcaaatgcaaaggtagaaaaaaagtagaaacaaaatatgagactgtttcagctgatgacagatcatgacagtcaaaaactaagataatgagaaaatctaaatttcttcatatactgaaacagactgtatttttttaatcaagggcccattgagtatatttttaattggctatatactgagccagaaaatggaagtagtacagaccatattttctcatgacaatacggtaacactagtagtacagaccatattttctttttttcttttttttttttttttttttttgagacggagtctcgctctttcgcccaggccggactgcagtggcgctttcttagctcactgcaagctccgcctcccgggttcacgccattctcctgcctcagcctccccagtagctgggactacaggcgcccgctaccgcgcccggctaattttttttgtatttttagtagagacggggtttcaccgtgttagccaggatggtctcgatctcctgacctcgtgatccgcccgcctcggcctccccagaccatattttctaatgacaatacggtaacactagaaattaataacaaaatgaaaataaaaatctttagcatgtagaaaataaacgggaaaaaaattcttccactttagtcgaagagaaaatctaatttgaaattgttgaatatctagaaaatgacaacaaacaatgaaaatatcagaagctagaggatatggttgactaaagcagtagttaaagaaaaacttgtaggctgggcgtggcagctcactcctgtaatcacagcactttgggaggccgaggcgggcggatcacttgaggccaggagttccagacgaggctgtccaacatggtaaaaccctgtctctactaagaatagaaaaattagccagatgtagtggcgtgcgcttgtaatcccagctactcgggaggctgaggcaggggaattgcttgaacctaggaggcggaggctgcagtgaactgagatcgcgccaatgcactccagagctccagccaggttgacagggtgagactctgtctcaagaaaaagaaaaagaaaaacttgtagccttaaatacttatattagtatgtaagaatgaattaaaataaatgaattaagcattcaacaaaagaagaaaagaatcataaaaataaacctaaaacaaagcagaaagacaataaaactaacggcagaaattaatatactagagaacaagtgatagaataattaaaggcaaaaccaattcctgaaaagaaaataaaaaacaatgaaacagattaaccacttgctaatctaattaaaaaaaaaacacccaaatgcacaaaattagaaattgagaaataaccacagttacagagtaaatgaaaagaataagagaatactttgctctaccccataaaacaaatttgaaaacttaaagtatttttctgtgaaaacaaatattaccaaaactgatttcagaagaatgagaatatataaacccaccagttaccataggaaaaaaaagtataaatttgaccaaaaatagcacaatcacatagtcttgtgttaattctaccaaccttcaaggaaaaaaaatcaaaccaatgttatttacattttctagaatctggaaatctagagaatagagagagaagaaaagattcctgcattacattgatactaaaacccagcaaacagaacagaaaaagcaaactagagacccatctcatctgagaatacagatgcaaaaatcttaaataaaatattagcaaacagaatctaagaggatgttaagaaatatgatacaccatgatcaagtggggttcatcctagaaatgtaagactggttcagtaatagaaaatctactgatataattgacaacattaataaatcaaaggataaaaggcacataacaatttccctaatgctaaaatgtatttgataacaattcaacatcacttccagataaaaaaaaaacctaacagaaaaagatgtctatttccataataccatcattatcatcagacttttgttttaaagtcaaaagccaatattgtgcttaatggcaaaacactagaggtatacccattaaaaacaagaacaaggcaaaggtgcccactttccccactaatatttaatattgttctgaaagcaatagtgcaatttaacaaaataaagatgtaaacattggaagaaggggatatcttctcattatgtatagatgatacgattatttatctggaaaattcatcagaaactttttttttgagacagagtccagctctgtcacctaggctggagtgcatgatctccgctcactgcaacctctgcctcccaggttcaagcgacactcgtgcctcagcctcccaagtagctaggactataggcatgcaccaccatacccggctaatttttgtatttttagtagagacagggttttgccatgttgcccaggctggtctcaaactcctggccttaagcaatccacccacttcggcctcgcaaagtgctaagattacaggcatgtgccactgtgcgcagcctcatcataaacaatttaaaaataataccaacaacaggaaaattcagtaaggtgtcagggtataaaattcatatatggaaatcatcttttctacatagatgcaacaattagttagaatatataatggagggaaagatcacatttactgcagcaattataaaggtaagatgcctagaaataaacctaacaagatatatgcaggatctatacgcaaaaactttaaaactctattgagaaacataaaactagatgcacataaatgaaaggactcacaatttcctagcaacgatgactcaacattgttaagatgtcaactccaagtgaatctataaacttaatagaaactcaataaaagtgtcaacagactgcattttggaacattattgtaaatttcatatgggaaaattaaaatcgtaagaattattatgaacggtatggaaaaagagagatgaaagagggaagaccagccctaccaattattgaaataatttctaaagttagcagtaaataaggcagtctcacaaatagaaaggtagatccatggaataaaacagagaacactagaacactgaagtcaactcaaatgcataggggaagttagtttgtgatgaagcatttcaaatagtgggggaaggatgaatcattcaatacgtagttttagaactggatagccattgagacaaaaataaagctgaatcatcctatcactttttacaacgaaataaagtttagatgtatcaagactcaattgtcaaaaaaataccataaaggtactagaagaaaacatttttaaaaatataaaataatcttggcaggataagttctttttaagtaagacacaaaacataaaagtaataagggaaagtttataaatttgacttcttaaaacttaaaaaattatgtccagaaaaaacaccataaagtctaaaggtgaagatatactgggaaaaatatttgtaacatatacaactaagagtaaatatccttaatatgtgaagtatgcttaccaatcaataaaagggaccaacaactccatagggagaaaaaggtatagttcacagaaaatgacttatcaatttaccaaaaggtgttcgacctcacttaaaatttaaaaaatgcaaatccaaacaataatgacactttttaaataaaaaaagttaaagaattaatgagggtataaggaaacaggtgatcttacacactgttggtgggagttgaaattagcataactcctagggagggcaatttggaaggcaaagaaggtaaaatgtgcatatcctttgacccagtagttcaacttctagggatttatcctacagacacattccaacatgaacacaaagagatatccataaggatattcactgtagatttgtatgtaatcacaaaagactggaaaccatctaaatgtccttcaatagggactaaataaaatagggaatatctatatatggaacactatgtagcgttaaaggtgatgcaatagagctatgtgtaacatagaataatcactaaaataaaaaagcaggatgtacaatagaaaagatatgcaatatgttcccatttttgtaaaaaagaatgtatatacatgcacacacgttacttttctggaaggatacacaacaaattgccagtaatgtctcttgtaaagagttgtactgatggtttggggtgagattctcttattgtgtgtgtgtgtgtgtgtgtgtgtgtgtgtgtatacactaaatgcatttattacttttttcaattaaaaattagtaaacagaaaaataaagcataaatctgattttgttatacatttttctgcttgaagcctacattattcataaaatacagacccttactaggatttgttaggtttcttaaaattctgcctttcctatcctcccacacttctttttgcctttacatgctgtttgctctttatcttctctttccgcctctttatctgacttacttttagaattccactgagatatcatttccttgaggaagccttccctgattcccccaaagcatgggataggtgcccagactgtcctctaacagcacccattaattttcctagcacactactgcttagttgtctgccccttccacataaccatattgagggtgaaggcacatgtcaagttcaccactgtatcactagtatccagcacagtgcccggcacacagtgggtgctcagtacatatttcttcaatgtgaaataaatgcaggtttgtgtgactatggaaaagaagaaaagttagatcttttttactgtaacctcgtagcccaggttgccaggcaatgggaacaatgagtagcaggtaaagcagtcagcagctgtccaattgctccagaatctgattggggtttgtgtgtggtggggggagggggagtggcctgggatttatctcgaggctgtgtttgcatagcaagtctgttgtttttacctaaattgcgtatttatttggggtagcgcaagctaatggaaattatttgctttgctcaaccttatcaagcttcctaattctattactgggctgatttaccctacagtgctcaaagagcaccggagttcatgagctgcatggagctttgctgctttgatcaaagctggtgccttgtcaatgccgtccttagctacacatctcaaaagatgaggtgcttgtctcatgtaggtgctctcataaaatgctgcttcctacttcaactgggtgcctggccaacgcccttcagccttgtccaatcattttttcagtttttggtatccaaagattaacgattaatgggttactgatatttaccttgaaacctttatggtcagttccctttttcttcattctggaggagttctgggtttgtagaaaaataaggtcaactctccactctactgggcttttaccattcttttttccttctccctgaaactggatttcaaccacctaccctttttttttgactggtcatttattttttagtctagggtagttgtgttcacagaacttcttttatatttatttttttctatttcttgcatttcaaagcataaatatgaggacattagcacatataagaaattaataaatatattgccaacatatgttgagggtacatgcttaaaaaattctttctgagaagggtacatgatccaactttcattggaaaccactagtctgggaaaacagctcataatcaaagtggctcctcattagaattacccaggaagttgtttaaaatgcaaattcataggccccaaccctagaaattgggtttcatacctctgtggtgggatccaggaatcagcattttaagcaattcacctaaaggattctaacacaggtggttcagggaccatatcatggaaacaaaggttcagagtaaaagggttgggagtgctatggtttgggggcagttatttgttccaattaggttggtttccaaactatacattctgtcccccatccctcaccacacacacctggttgcccatttctatctcctgtccctgcctctctcccgaccttcacctccgatgtagattttatgaaatgcagcaatatcctcaaaggcaacaattgggccaatgtattgcagctgtgatgaaaacaaccctgctccatgataacaatcaaatttaccacattttcttcttccctaaccagggcacaggacaggcaattgagcaaagcagaaagaacacagtgttggaaagacttgggtctgaattccaataaaatttaaaaatctggctctataactcaaaagctgtgtgaccttgagcaaggtatttcacttacctcattttcaacaaaatacctatcttacaaataagcagtcataaggatgaactatgtaaaaaggacctagaaatgatgctaggaacatggaaaattgccttcacaattgtatgcttcaggcttgctccttgttcccatcaagagaattggactgcactccctgattaatgttcaaccctgctcaatagccaagaaaccaggagacctcaagtcccagctcaaccacatagctgactagccaggaggccctagtttactaaggagtttaagcctggactcattcactcaaacttttcctatctactaaaaagggagatataataaaaggcaagtttagggttaagagcagtgtgacaatcaaaaggtctggatattcaaaggtgtcttaagtactaactatgtgtgttagccttaaaaaaatccccccccccaccccatcccggtaataaactccagaaacagttggaagaaaagaacatgcccttctagggacatctggtgccccaagtcatggaactgtgaccctatctggaggtactgggcacaaggcaacttgggaattgctattctctgcatcagccctcattttaaaaccactgccctcccactcacttgccctgtgttggggcagcctgagacttgcagagtcacttatatcaagcaggcagaagaagaccaactccagaaggggaagggctacccttaatgggatcatctgggccaacgtgtgtactagtcattccttcaacaaatccttgctgaatattacactgtgcaagatgaccagatcaaaggggagcaaaaccaatgttgctcctgtcttcctggctttaacaattgaagcaaaatggtgatggtgaaagggaggcttccattgaagggtgtcagcctcaagccaaggatattggttggcctctagaagtcctattttcaaggggatcaggcctcctaaatgtacagaaatttgcaactctgctttgagaccaagtaaggattctttccttggagtggagggcaaggagcttcattaaggaaaaggaactactctggtttctttcttttcttctcttctcttccccttccttccttccttccttccttccttccttccttccttccttccttccttccttccttccttccttccttccttccttccttccttccttccttccttccttccttccttccttccttccttccttccttccttccttcctttcttatttttgagacagtgtcttgcccagtctagagtgcagtggcgcaatcttggccgactgcaacctctgcctcccaggttcaagtgattctcatgcctcagcctccccgtgtgccaccatgcctagctaatttttgtatttttagtagaaactggtttttgccatgttggccaggttggtctcgaactcctgacctcaagtgatctatccaccttggcctcccaaagttctgggattacaggcgtgagccaccgcacccagtcgactactctggttgccaagtgttgggccccgtgttaggcactttcacgtatgtatttccattaatcttcacaacaaccattattgtcagtttgcagatgagactcctgaggcttaaaaaggataaatcattttcccagctagtaaaaagcacagtgtccagacctgccttgtctgtctctgagagataatcgcagggaagcagggactcctggggtacagcaaaaggtacttgtgctacattcatcctcgggcgtccatgaaggctttagcgcctcactgaggaaagcagaggaagcatgaaagcaaactatgagaaagggctttgttgacatcagcaaggagactacatctcaaaaacaaaagtaaattgcctgccaaaaccagggttgttcatctcttttccgcttccatgggttgccttttcttctgaagaacggattttccctttttgttaaaatatttttttttggcctaataggaattgaaaatgaaaaccaatatttgcagagactgaaaaatctcctcctacctcttcctcggcccttttgaagtttcttgtttggaaactttatttttaagctcaccacaatagcttggcattctagaatctcagtagcaacagcacacaagcccaacccgtctcgcctttcccttccctcagcagccaagtaagactgctccaagagaaacagacactcccaggttattgccgaaggaaatatttgcaagatccaggaagtgagacgcaaggaggatacacagggaggggagaaggacccagagagcctgttgctgccacccctgcttgcccccgggcccacagaaattcaagtaatgaacaattagcttggcaacaacaaatgcaagtggcagtgcttgccctgaaccttctctagtcctcaggaggctgatgcaaagtgtcctgtgaagaaatcagagaagtccttgctttactggggctgtcctgggtgaagcttagctccttctctccaatgaccccaatctatatttgttgtcaagtaatacatacatatgcagtcactgtggtagagagaaaatgtgcttctttgtgaataatagcactgaaatgcaaactagtgctagtgatagaaatgaagggaaatggaaaagctttaagaaagggatggttctgaggcagataataaaatgtttattggtgggggtgtgtgtgagggggtactatgttgtagtggtggtgacaaatttggagattcgtagaggtctggtgatgtcaaagttcttgtggatttaagcaagcaaaagtgctagtggatggagaattctagcaaacccaattctagctagcagtgagagtaagcatgtctggtaagtaacattgtctgtcattggtacggggattttttacaaagcccttgatctttaacttctcgggtctatatcaaaccaacgtgggccacctcttattcagattttctttttaattataaattccaacaacttgacatgtacctaaagaacaccatgtacattcatatccaactatttacattttgccagattcctttctgaattttctttgtgtatggctactatcagattagattcaacatgtggtttcatatttattatttttttgttaatattacaaccactcatttctgggaaagacccaacatttgtatacctgtcactgttgatggctattctattttgttccaagatgatgatatattagattggtaaactctttccatgagtataataagcactactatgaacatctttaaataattttttccctcttaggttatttccttgggggtattttaggccaaataatatgaacacatatttctagattgtcctctaggaagactaaacccagaaacacatactcttgtcacatttttctagattgccctctaggaagactaaaccaatttgtattgtttccagaagcacgtttcctcacagccttgccaaggtagcattttacaatttctatttattgatttttttaattgctgatagtttaataagcagattatgatgccttgaagttgcttctatttgtacttctttaattgctagagaggtggtacttttccatgcaatgattttactccctttattgcctcatgtgtaaattgcctgttcattttccttgcccacttacgaagctaaatctgaaagctgaccttctacccatttttatatatatattttttggacatgcaactgttgtcagtgatgctgatcccagacattttcctcgttctgttgcttagctttttattacattttgttgtacaaaggcttcccccccaccaacttttatatatttgaatccatcgatcttgtctctgatgatatcctccatttaacagacacaaatttatcttccatccacacctggaataaatatgcgattctactggtccactttctatacagtatgtgatatgaatctaagttaattattctccatattgatatctaaaattcccaacattttttaaagaaatagtaattgctttccccagttcagggttgtttccagtgtgtcctatatacttaaaatagcttgagtctgtttctagaagctcttttttaatttcactgtttgactttttttaacccactatcatatggttttgataattgttgttttatgatacgctttaaaatctgatagggtaagtctaccatcattaacttttaaaataaatgtactctttggtatttccgcccacttacttattcttccagataaattttactataaatttgacaaattctataaagtatcccatggtgactacaattggagtacattatgtctacacattaaatttagggagaattgtaatcattactatattcagtcttcctaaattaaagcaaagtatacactatgcatttattcatattatttctcccattagagttttataattttccttgaataagtttcgtgtgcctggcgttaaattaattcctaagtatttaaattcacttagttatacttgtgacaaatccttccgagcctctgaaggctgcattcttcttaggtagtaaaggcttcctgaaaagtgtactcttcctaatgaaatcagattcaactctgaattacccatattctttcactcaatcagtaaataggaactctgtaccgggtatttcacactctgctcatgatgtggtgtgacaaagggaaggaagagaaccctaggctgagaatggaaaatcctaagtagagctctagtttggtcacttacttgctgtataatcccagtagtaatgggctctgaagtcagatgcctgtttgaccttgggcaaatgactttaatctctttgtgagtcaatttcttcatctgcaaaactgggtcaataaacagtaatgctctcacggggttattacaaataataaaatacttcatatgaaatgcttacaacagtgtctgacacagaataaacactcaataaatgttagctattatacctgttgtggctgctgttaatggtataataccttttctgagtcttggcttcctcatcagtaaaacgggaaaaataaggtttaacctcagtgttgttgtgagaattaactgtggtcatgcatataaaaacaccctacacattctaaagttctgtgcaaagtgaaaaaaatggaaagggtcacagcaggcaatcataggtacagaaaaccaagagagataatccagaaaataacttattttggcttttaaatatatcacagtaatgtagctttttctcccagtagatctactcaccatttttatccctcctgctaatattacaatttttacattctcttcacggaaaaccaaataacagtggaggaagacaactaagagtataactacctgaaattagcaattcattgcaggcttccaggcaaagagagtggcttaagaatacacatttgatttttccacctacactcatcattccagtttttacagaaataacatagtaaatgttaaaatttgtgtgtgtggtggtgggggaaggtgtgaagggaaactctatcaggatttctcctcacagatgtcatctatgccctggacatctcctagtccttctcatgtttcctgagacctttaattgggacctgcctcttccatcttcagtgtcaatacttccttttctattgagctttcctttctgttttaaacttaattcagttttctagattctgactgaagtttcatttgaactggtggttctgaaacttagcttgcgtcagaattgcctggagggcttgttaaaacagagattgctgggccacatcctcactttctgaatcagtaggtctgagtatggcctgagaatgtgcatttctaacaagttctcaggtgatactgaggttgctgggcctggggccacattttgagaaccactaaattaaacccaattgctccctctaactatcatcctatttctctctttccttttcctagctaatttactatttttaaacatcttcctttttaaacatttttttttcttttgagacagagtctcgttctgttgcccaggctggagtgcagtatcacaatcttggctcactgcaacatccgcgtcccagattcaagcgattctcctgcctcagcctcctgagtagctgggattacaggcgcctgccaccatggctggctaatttttatatttttagtagagacggggtttcaccatgttggccaagctggtctcgaactcctgacctcaagggatctgccggcttcggcctaccaaagtgttgagattacaggtgtgagccaccgcgccgggcccctttttaaacattttaaaaaccacacagtaacaattaatctttgtagtaaaattagccaaaagaaactggaactctcttttgctggtgggaatgtaaaatggtgcagtcgctttagaaaacgggcagttcctcaaaaagttaaacaataaaattaccatttggcccagcaatttcactcttaaatatgtaccaaagataattaaaaacataaatctacacagaaacttgtacatgaatgttcatagcagtaatattcacaatagccaaaaagtgaaaacaacccaacaatccattagtggaaggactagtaaacaaaatgtgatgcatccatacaatggaatattatttggaaataaaaaggaacgaagtactgatacatggatgaactgctaaacattatgctaagtgaaaggagtcaggcataaaagaccacatattgtgcgattagagtcatatgcagtgcacagaaaaggaagatctataaagacaaagtagattagtggttgcttaaggttgagagtgggaatggagagcaatggctaatgggcatgaggggtctttttagggtgatagaaatgttctaaaacttgattgtggtgattgtacatcactgtaaatttactaaaaatcattgaattgtacacttagaacaggtacttgcatttaaattgcattaaattgtacacttaaaacaggtacacttaaaagctgcttgcatttcttctctgtgctccccccttacagaccaccatgccatctattttctatgcctaccgctttactgaatttgctttcttgaaggtcacttgtaattccaaactgttaagggcattaacagtcatctgcttatcttctacactggcagatttctccttctactacttcagctgcttgacccttcagtttcctttgttgattcttcttcctcatcctgtgccctggctgggtgtttgacaagccttgaaagactcaacttgtatcttccactaacttcaaatacaacatatcccaattcaaacttagcagcatcttcaccaaaccaggtccccttctcaagtgccccatctatgccaataacattctccaagtcactggggctcagagttgttttttatctttttatctttttttttttttttttgagacagggtctcgctctgtcacccaggatggaatgcggtcatgtgatcacagctcactgccgcctcgaacacctgggcttaagtgatcctcccacctcagcctcctgagcagttaggactacaggtgtgtactatctcatgcttggctaagatatatttccttttttctcctcaagttctagtcaccaagttttctctaccttgccctcaaaaggtgtcacatatttgtgagcaaataatctgaacagataattcacatgagaagcaataaagatattaatatattaattagacacacaaaatattcaaactagaattatcaaagtaagcaaattaatactataataggtcccatcaaactgtatggcattagaaaaagaaaattttcaatggtgacataattttggaaaactggtatgctcatatattgctaatggcatgtaaaacatctcgtggggaaaacagtttggtaagatctatgaagaaccataagaatgtttgtattgtttgcactagtaatcccaactccacataattgtttttaatgagataattcaaaatgagaaaaaaagctatagtgactcaaaatatttctgctgcattactttataatagccagaaattggaaacaacctatttacccaacaatttgggaatgattaagcaaattagagcatattaagctggtgaaatattatacagccactaaaaattatgacttgaggaagcctgcatagcaacatgaaaagttgtttaccacataatgcttagagaggaaaaagaagcaggacacacaaaattacatctacatggttattataatcatgcttagaaaactctctatacctatagataaagctgacagggaaatgaaaacaaccaaggtgttaaggtggtgacaataaggtttttttttcttctatttttaatttcctgtaatattgtttttacaataaacaaactcccctcccccaaatatcacacctatttatctattccttctgctccatttctatcgcacctctacctccccaatccagggccacattctgtcatggccagatcacttctcctaattggtctctcttcaacccacttaggctgcaaacactgcaaagttgcctaaagggccacatttatcatatcacttacctgatggtaacctttcattgctcccatgtttgtgatcctatctaggtttacctaggctggtctacctaggctggtcaaggcctgcctaggctggtccagtgcttcactactcacctttcttctctgctgctgctgttcttcttcctcctcattacagataacatttcctgagagtttacggtgtcaggttttgctctaaatgctttacatatattaattcatttagtcctcataacaacaaacatttgagataggtactcttatcccattttataaataaggggggaagggaaagagagagagggagtgaggcaggcaggtaggcacttgccaaggccacatggctagtgaatagaagaatctggctttgtacccaggcagaactgactccaaggccagaacttaaccagtggggattattcctccaacacaccctgcttagtctcctctatgggcctttcctcttacagctaccaaccctcagttatttttatcctccaatgaacttaaatagtgtacagtaatagttaccacgtgctgcccccttaccaggtgccaggtgcttcttaagccctgtatttgacagggtttcatcttctgtcaacttgtgtgagaaagtaaaagctgggcttaattcctagcttatccctttactagctgtgagaccttgagtagattccttaggctctctgactgtgaccctttatgtgagttagcaattctcaaactggatcccaggaccagctgcatcagcatcacccagatgctgtttgagcctgttcgaattgcaggttttgagctccactccccacttactgaatcactctcaggatgcagggtcaggtccaactatttatctgtgtttcaattgcgcaatcaagttttgagacccaccgccccagttataatcatacctacctgacagagttgttgggaagataaagcataagataatatgtgtaattcggcttgcagcacataggttgtttggcaagtggtaatttattattattgccatttagctttgtgtgggttagtcttccctgctcaagctgtgggcaggcactgtgcttcctgctgttcttttgctcgtatttctcaccttgcccagaaaaaggcaggacctatattaggttttcaataaagtcctcttatttcactgactaatcagtaaaagaaccatttcagagaaacactgtaatgtagtatagtgtccctgaagctagaccgcctgggtctagtcaactgattagctgtgggacttcaggcaaatgaatgtatctctgtgtgcctcaatttcttctctctgtcaaatggagagactaatattaccaactccataaggtcatagtgataaatacatacttgtaaaatgatttgaatggggtctagaatagagcactgtgttcaagaaatgttagctagcattattttgtgtcatttcacccattaatggtggaggaggttccatttcttcatttggcaagcaaatgacaagtacctcttgagcaacttctctgtatcgggcaccgtactaggtacagagaataaagctatgaccaaggtatggtgtcctctctcaaggatctcagtctaatacaggaaacttgcatattccaaaatgtcctagcaatcagtttggtctgtacccagctatctaggagtgcggggggcagggggacaggctgaattatatctatggtatcaagcccttagtctagataccaggccagtttcctcaaaggaaactaagcaaaccaaagaccttagcaatttctacagaagctccagaggcaccaacccaccccaactccctgagcgctcacttacctccctgactggctggtcttcctgtttcctgttattggattccatttgtccccaggaaattcctgtaaagaaaaatcctgataagttagaaagctttgagcagccaggtatctagatggcctcaaaaatgtgaagaggtcaggagccggtgtctggcccagccccccagcttgtttcttctactctgctatgcaggctgagaaatttgtacctggagggctgcctttctgtcggcaggcttgctaaactgctgcagacatgcagagactaagggagcacttagggacctggacaccatggtctaggaatgctgtttccctctttctccactcccctcccaaaccacattaaaaaccagtttagtatgtttgctgtttgccctggctcttgcctgcacagagagatggaggtctttttgtttgttctgctgggtgaacctgctcattcctcctgcctcttccaacagagaaagcatctacttggaagccctgacccttgaggggggctttgagggcagaagctccggctgcagcaaccctctccccaggtgaggcagagggacagcaggtatgccagcatgcctccaactgcagtggctcctccttctctgcccacatctgctggcaggggctgaggtgggcccatctctggggaatatgagtgcaggttgccacagtccctacattacaggagcagactctctaccctgggcattttttccttaagggccatgtccaagcaactcttttttttttctaggccaagccatatgtgccgtttgtaaaactgtccctgccttcctattttagctccaaactgaatgcaaattagcctttcagattctctctttgtatccaatactccacacctagagactcagagtttagttcaatgggaatgcacagtttttcctaaatttcactgatcttccaaactccctctttctccaatgctactactattagtcccattcaaagttttattacctttgccccagtaggtctccctactggaagtaagacgcctggtgaagcagaataaacatagatccttggcgcagtctcactggctaagacacttaatagtggtgttatttgaggttattcatattacctccttgaacctcacctcagtttcctatctgggtgaccagtagtgataataaataagatatgcagagagaactcctagcacattgcttggcacataagaggctctggatgttagcagcaatggaaaagttgaggtttatttcttggcttcagcttttaaaggaccacagcagtccctgcctatatctggcatgtcagaacagctctaaccacttgtactttagactctgcctcgatgcccttgtgagacgttcctgcctgcaaagacaccattacttgttcaaccacagtgggggccaggatttcctgtccatgccctgtctagccctgtggacgtgctcagtaaatagcagtggccaaaccaaagtcctataccaactcccaaccaccttcccaggtccacagtatcactctactttttttttccctaagccacataggttcctggtacattgcttgcaccctttgaatcaaagaggcagttatccccaccgcttgctgcaaatggagattgtgatgggaacttgctgtcccagtggaagtgatactgctagagggcatccggccacactagagagggcctgggctttgcaatcagcttatggagaggcagtgtagcacagtcaggagcttggcctctggagcttgatagcatggattcaaatcgcacacctgcctttcacttgcggcctcaggcaagccattcaacttctctttatctcagtttccccaactatataatagtataatcacgataataatattgcttgagaactcaatgacttgatacatgtaaagcatctagaatagtacctggtgcccagtagacactgagatgctagttactgtcatgttattcaaattctggctctgccacttgctagatgtgtgacctctctgagccttggctttctcagcttcctcagctgtaaaatgggagatcctattataacttatcccatacaattggtaagtgaaataatttgacaatgaatgaaaaacaagctggtatgaaggacgtgagtgcatgctgatttcagtcttcacagcactgaacaggagacaattagttcaccaacctcgtccaggggcattaggagcaggatctcagccctacttcagatagctaccaccacaagtacctgagtcatcagagcgatggcatcttaacccatgctgcaagtttttcccatttcttgaggggggtggagtaggagtggaaggttcagatgatgggcagaaatgggcatgtggtgtctcctaggcagccatccacgtgtcggaatgcctagtatctaagcagacctgcttagctggtctaacaagcattaggaacccaaggtatccctccctcagagtacaaaaaatagaggcatggtgtaggcacagcctcacccgcatgcattactgctgccaattgctgcaacctgcaaatcgtacctccatctcttatagagctgctggtcctgggctgacaccgctgcagccgtcatctcctcacttcccccgccccactcacccccaatctcagccccctttgtctactgtctatctgtgagtccttcttccagcaaaagtctctcaagctaagccaaaatgtccctttaagagatgataactcacttataagatgattacaatctggcagtcactgctctgagtcttaaatgtgttacatcacttaatccccacaaccaacttatgaagtaggtgttgttactacccccatgcttttagatgggaaagcttaggcattgtaagttcgggggaagaaattcaaaaccaggcagtctggttccagcttcggtgcccttaaaaccattattttatatttcctctcctctttttttcaacattatgaatatattcaaacatacaaaaatgttgaaagaagttcacagtgatcacccatatacccagcacctagattctacaattaacattttgatatatttgccttatcatatatccatttactcctctatccatctaccaatccatcttaaaatcctggtgcattttaaagtaagttgaaaacaactatatccccataaattttaaaatgtaaatgaaatggacaaatttcttgaaagacacaaactactaaagcttactcaaggagaaatagatgacctaaatgtccccaaatctattaaagaaattgaatttgtagttaaaaagctttctaccaaaaaacctccaggcccagatggcttcagtgatgaattcaagcaaacatttaaggaagacattttatacaaactcttcctgaaaataaaagagaagggaatacatcccaactcattttttaaggctagcattaccttgatacaaacaaacaaaaaaaacaaaaaacagaaaaagatgttataataaaactatagactaaaatccctgataaacataagggcaaaatccttaacaaaatattagcaaatctagtaacatataaaaggataatacatcatgaccaagtgggatttatcctggcaatgctaggcttctatttattttaaaaatcaatcaatgtcattcaccacatcagtagactaaaagagaaaaactatatgatcatctcaacagatacagaaaaagcatttgaaaaaaaatacaacatccacttctgatgaaaactctcagtaaactaagaataaaagagattttcctcaattaaagggcacctacaaaaaaatcctacagctaacatcaaactttatagtcaaagattaagaaaaaagctacaatgtccactcttaccatttcctccaaacattgtattgaaggtgagagtgcaataaggctcttctctctcccagaaaagggcatgtacaggagaaaggaagacactaaattctatttggagatggcatgattgtgtatgtagaaaatgttttataatccaccaaaaagctattagaactaataagtgagtttggcaaggttgcaggatacaatgtcaatacacaaaattcaattatatttctatagactagtaatcaagaatttcaacttgacattaagaaaataatactctttataatagcatctaaaaacataaaatcttagggacaaatatccctggtggttgggtggctaggattcggcgctttcataaaatctcagggacaaatataacaaaatatgtacaagatttgtatgctgaaaacataagttgaatacagcagtatacttcaaacacacttcagcatacatattaaataaagtttaatatttgtttacaacatttttaggcaaaatttacttccagtgaaatgcacaaatactaagtgcattggctgtctaggagccttgctatacatttgttgagttctgacaggtacatatgtttaactcaaactcttaccaagatatagaacattgtcaccaccccacaagttccctctgcccttttccagtcaatctctgtgccacctcccattggcgagcagtgttctgaatttgttcccccatagaatagctgttttagaatttcatataaaaggaattgtagagttcatagtcttttgtgtaaggcttctatcacccttgaagttcctttttaccaaggatatatattgagcaaattcagatactaagtcatttcaaaagtgtctgtgtatgcaacagctgaacacaggaattaacttctggtttgaatgcaccggccaaaagatggcatcagggatgccatggggaagtaatctggcagtgagtaggcaaggacctagggagtcctcccagaagtagcctgggggatggtggtagcttgtgttatggtaataggtcataaccgggatataagagcagccagtttagacctgggtctccaacagagacaggatggagaaaggggaaaggatttgtctttttaaaaacccaacaagtcagatctctgaaagcaaagcctggggatatttgcaagttttgcatctctaaatacttctgaagtagaaaatgggaggcaataagtgatattttgtatcatgcactgggcctagaactccatagacacaatctgatttgattctcacaagtgatccatgaggcggccatgatattcctccattttagagatgaggtagtgagactcttcttaatactggctattttatgacagaaaaattattttttccctttagaattacatacttcaaatttgtgtggttgaatgacttgctttgggtcactcagatatcaattttatagtcaggatataaatctcagttgtgcccattttatgaagcaaaagttacttttatctaaccctaaagatgagacaactgcaattttggtggctgagtatctttttcaaggttactaagctaacaactactgaagccagtgctgtacagtttcaaggaattataattgttatatttttaaataatttacgtagctttcccctctcaaagacaataatgaaggttacccacccaagaaccaagtcctcacctgcactgtcagcttcctgggtttccaagtgttgccaggtgccaagctgctgtcctcgagggcactgtgctgaggattatgatagcaaactgaacaccgaatgcattggtggtggtggcaccggcagttgtagcaatttggcatcatatttctctttagcaaggcagggcagatttccccagaacaataaatgcaaggatcatggactagagctccttgaacactgcaggagtaagagcaggtcctgtggtaatcaaaatcaccacagtgtagtggcttacaacacatggaattttctagacctttgcttgcaaaacattctgagtaagtgggagtttctgactgaaggggtgacatggaatgatatgattggtctgtggcatgatatggttggtctgcggaatgatatgattggtccatgggatggcgcctcaattccctacagctggagctcattggctggaagttttggtctataggttttggtctctgggtaaaagtcttgttgctatgagtggttaaacctggcaaatgagatgtagataaggatttgctactctcttcaaagaactttcttctgtctgcaaaaggcaagaggatggcatcctccccagcttgagcagtagaagccttcaattccttgttgtcacctgggttggaagggccttccatggctgctgccacaagtggctgtgaattatgctctggagaccatctccaatgacctccacggactccacagtgagcatgtgctttctcagggtctgaggaggatgggtcaggtgctttccaccaggtgttcaggcccaaagaggactggccaggcctctggccagggcttattcgtccctctaagcctgtcctagattcatggctctcaggggcttggctgaggcactcggaagacctagctctgagcatcatgcttttgttgaagagcttgtctctggggctgggaggttttttacatgaagatagaagagatgtgttagaggcagtgagtggaggactttctgggggctcctgggtctcttccactggctccttagtgtcacacagctgtgacaagggacccttgcttttctggagctgggccttcctcctctgaatttcattacgcagattggtagcaaaacgctcactcttccgccggttttggatcgagcggccccgggtccctccacttcgcctaccacccatccggctgcactccttgggctcgctgtccccttcttcacctgcctctgtgccactagctgctttagtggttgaagaacagtccgtggcttgttgaacaagggagccagaggcagagggttgctggttggccaattcactggctgctctgcttgttctgtttgggtccaggaaacctttttctgaggggtgtccatcagcctctccatgtgggggactgctttggctctggtgtcccaaaactaaagacctgtcatccacttgtctggtctttctttctttgctggactggtcatgggttcctcctgtaggggggcatggacttttcttccctttgtggctgctgtgcaaaggggacagagtccactggtgcccatcctgtacgggtgggagctccatccctttgctgcccctggtatcaaggtgcacatgctgcaggtgggatgccagcagctgttcaggggcactatggcgatgccctgtgggtcctatgagatgtggaggtctgccaaaagaagccttagctagctctgcagaagcctcattgagtgggttggaatccacgctggaagctctgtcacaggcttttggggatccaacagctttggttgaggcctgcatcagtagatgctcagagccctgttggctggattcaggaggctgactgaactcacagttctgatggccctcacttgtcacttggtcatgcccactgaggcaacagaacctattagggttccttgcgggtagcacaggctctaagctcagtttctccttctgtggcaaggggaccacaggctcagatgccctgcgctgctctccattgaggagttgggctctggaggcctgaaggctgtcccgcctcactggaggttgtggtgggcccctgactgctttggcgggccctgactggtatccctcctgtggacgggatgacatctgagagctgggggtcaggtggcccccattggtgcgccgactacctcctgaggtctcagccacattaggccggccactgggggccttagttggccctgggccttgcatgatgcagtctgtagaggctggctcctctggcctgagggaaagggcacagtcagaagcatttgagctggccgagaaggagctgtaggctgagtcacgctggttagggtacatgttctggtcaataggcaacagatggctctcataggtggcttggcctggttgctccaggctctccatgctgccaatggagctgcttttctcggtgctgcaatgccgggagagtggacaccactgcacacacacgtcactgtaagacacagggcatactggttagttagcgaagtcatggccagccctactataggagagggcaggccagcccagaggtacccatgccacaaaagagaggagggtaggcaaaaaaaaaaaagggggaagaaagggaaacagggaagaagatggacattggggtgcctcaggggcttagtaaaatgggacacaagatgatatatggaaaaaagatggggaaacaccccaaagactaaaagtgggagagctctatgggggttatcctctatttccctgacattagcaagtctgaaattgcttctaggctgtccctgtccctagggagtcagcatgtggctccctgccaaaagagacaatcacagaatatcagcattagagaggggccctaaagggctgattcagttttagccggaccattttgtaaataaatcagtgattctcaaacttgagcatgtgcgtcagaatcacatgcagggcttgttgaaacacgggtcacttgtcctcatcctagagctttaggtctcggtgaatcctgagaatttgtacttccaacaacttcccaggtgctgctggggctgcttgctcatccagcaatcacacttttgagaaccactggtgtaaagcaagcccagcaaagggaagtgattttgagatggtgatttactcaagaacacccagctctaactactggcacagacagggctgtaattcaggtgttcccctattcttttcttgataatagcaatcctgactatttactgaggacctacaatgtgccggacactttacaaggtttcatttcaagctgaagaggacagatctttttttttctttttcaacctttattttagattccgggggtacacgtacaggtttgttacaaaggtatatcacatgatgctgaggtgtggagtacaattgaactcatcacctgggaagtgagcagagtacccaacaggtagtttttcaacccttgtcccacttcctttctccctgcttttgtattctccagtgtctattgttcccatctttatgggacagattattatctacacttcacaatggaagaatcttaagcttagagaggtaaagtaaactgacaaactcactaagctgctgaagaagcacagctggaatctgaatcaggcctgagtccagtgtcttagcgctactgccatatggtcttttaaataggaataatagtaatagctatatcagagggttgatgtgtagataaagcagatagtaaatgtaaagtccttaccacagcccaggtacctagcaagggttcaatacatggcagctgctactctcttgattattagtttttgccatcaggatcctctctaatactagtattgataatataggggcctctgcccacccacgcctcccccaactcccacagcaaagccaaacctggaagaccaagggaagggctaggatcagatgcaatcttcaattttaagtaccatttcccaaacacaaagccaaactgaaccaagtcatgccagtaactccctttgactagaacccgagaggttgcaggctgctctcagaaaggccatagtctagaaagccagagttgaactgtggcagcagcccatgagaccctcaggtcattttctgctcattcttgctccctgccttgccccttagtcagtcagctcacttgttctctgggcaaggaatccatcaatttcttattggcaagggaacctgctacccactccaccactattcctgctgaaaagaacaaaaacaaaaacaaatcctcactcaaacaggagccaagctcaagaatgtcaaagtgtgtttctgcatattcttccagaacaaaactgcctgtgccctgagcccttggtttccaaataaagtcaccgaattggggtaaacgcaacccttagtttctctgaacctgcaacagaaatcccttcttggagggaagctcttgtggaagggaaaaggcagtgaagggcagcacctttgctggctctcagcctgaagaaaacgttgtctgcctcttgggcaactgtttcaacaatggttattcaggaaggtccctattttgaaggctttggctatgtgacagaggtaataaagaccagataagggcaccagtgagtcgccattgacagagaagcaggccagaactgagccctggggtcctcctacattaagagacaggagaacaaaaggaattaggaaaagagatacggagaaagaacagctagtgaaatagaatgaaaagcaggacagtgtggtgtcttgtaagcccaatgaggtatttcaaggaaacatcatccagaaggaaagggactagcccaaaatcacagagaattagcaagagactagcacttgaactcaggtactctggactcccacttgcttttccattatagtacttgaggctctaacatccaacagggactagagcagaggaggaggagtgtccaaggtgtctaccctccagcctgtcttgaggggagggctctagactcaccttgtgttgcagccagaatgccaggacaagctgaaggcttcagaagggaaatgcatggtggtggctgcttcagggcatccctccagcagcttggccacatgccatgagtgcggcctactgacaggggcgttcctcctacagcaagaaagggacaggaagtgggctgaaggaaccagagctgaaatcacttcccaggcagcttccgccccaccccctcttttccttcagtaaagtagaacatcttgcaaggaactggtgtgggaatcttagtggccctcctgagctcctagttctcaagtctccttcattctggagatatggaatgtcagcttcatagggctgctttgttcacaagagtatcctgagcacgtatcacagtgctggacacatagtagatgttcaataaatatttgtggaataaatgagtgctgctgcctaatgaacagtgagcacatcctcacttctctttgagaaagaaaatcaatctggtcaatcttcccatttttctctgagaaaggaatgggcaagtgattgaaaagtttgaacaggtcaacactgggctgtcaattctccaatttttagccattcattgaataagcatttgttgtatgtttactgtgtgtcctctacgtgtaactctgggattacagagatgaatccaatacagtctttgctcttgagagcttacagactaatgggagagacagagctggttcaaacaaagcatgggataggtattgacagagtgaaagataagatgggtacagaggtgagacacctgagttggtaggcaaactggtggcaggaagccccaactcctgtgagggaagatagaacaaagtggtgaatgcaccatgttaggctgacagaggagattggctgctcagcaggtcaggggtatataaagggaaataggcctgaggccatgactctgaatacagccacaacttttgcactgactgccacatacaggacccatcgctgtcccctggcatacttcgcatgagcagttgccacccttgcgagtggggaagagtagtgtggtgaagagtacatgtggggcatggataatgccaggagataaaaaggtgattgatgggagggagaatgacagaaggagggagagtagagagagaatggagagagagagatgctggaagcgccagacaaatgatagagataagaaggagagatgatagaggggaaaataaatgacagaaaaagagaaaactctgagaaagattgtagagaaatatatagtagagagaaatggatgacagagaaagaggtgaatggcagagtaaaagaaacatgataaataagtagatgatacagaagtaaacagaaaaattattttcatcaatttattcatatttactgtgccagggtccagactaggcactggtagcacagggttgaataggataagggcccctgccttcaacaagctggctatatcgtgagataaagcagctctctacctcccaggagcattcatggtcacactcaagctggaggattccatcctagctggaaatgcccctcaccccagcagaagcatagaagatctcagtagtacaaggctctagagggctaaggcctaaaaagatagtcttcagaagaatagccttgctggggaaaacaaggattgagtggtaataggccagacacagaccaggaggtataggaggaagggcaggggaagctgtttgtcaaaggccaggaagtatagccacaggtcagcaacagtggctaagatttaagcggaggaaagccaggtgaagcccctagctttgtaatcacattgttctattattgatttcagagtgcccagagtgggggctgaaggcacaaggagaccttgggggctatgcttgctctggagtcctacacacaaagccacactgccgggaaatctctccagctgctgctaccaggtagttatccggtcaacaactatttgtcaagcatctaccagtagtagtactatgtaccatgggtatctactatgacctatgcttttagacactgaggatatagtggtgaacagggtatccttcctatttcaagcctttttccatatttagggttcttgagttctgggtttaaagtgcgggcagtcagccttggtgccaccttctccctaaccatccaatcccacacggagttctactgagtcttttttttatgatgtttctctggccctggtttgctctctctctctctccccctaccccccctccattttcactgtggccattagacagaaccacagctcttctcccagaacccaccaccagcagctcctgttctagtccaggcccttgaaactttatgccccaaatactgcagaagtctgccggcctgtctgccttgttctacctccagtcactgcttttaggtcatatcatgttaaacgccaactgaattggggtactctcctattcaagaatcttcactggctccctatttcttactctgtcccacatcaaacgtaaactagatcagtttcaaagtcttcaataagctatccttacccatcagctcaatctctcatttctctgctccaatcacagcctgcaaccagctctgtcccttcctgattctgtgcctttgctgttgatattcctgttgatctaacacaggctctggggtcagaccacctttgtttgaatcccagctctaccactcattagctctgttgctttagacaggtgacttcacttctcagagccctagttttcatggcagtaaaatgtggataatagtaccaaatgggattgttgaaagatcaaatgagacaatgcaagtgctttgaatcaggcctggcaaggcctcgaccaatcatagttatgactatgactgttccctctgcctggaatgccccctctccttttgttaacctaaatcctacctgttcttcaaggtactgctcaagtaccatctcctccaggaagcttgttcagggtaatctagccctcacaattgggtccataataatatgatatttgatattgcccatcatcatttcatgtgtgtcagtctcatctcaccaactataccaagccagtaggcaatgggtgaaaaatgagtgagacagatgtaggttcagatcccctctgccactttagatgtgtgtatctgtaagttgcttaacccatctgaaatttagttttcttatctgagaaaggaaacaataattcctatctggctaggtgactgtggggattagagatagtattctcaaagcatctgggacacagcctgatgcacagcaagtggtcagtaagtagcaggtactataataatggttattagctcagacttgtaccttttgatggctcaagagtacccacacctagggtaccatccactgttgaggttctactgtaccactaccttgccacactgtgaaacataccttacaaagactcttactattttttttttttttttgagacgaagtctcattcttgtcgccaagcctggagtgcaatggcacaatcttggctgactgcaacctccgcctccctggttcaagcaattctcctgcctcagcctcctgagtagctaggattacaggcatgtgccaccatgcccagctaattttgtatttttagtagagatggggtttcaccaggttggccaggttcatcttgaactcctgacctcaggtgatccacccgcttcggcctcccaaagtgctgggattacaagcgtgagccactgcgcctggctggccccttactctttctagggtttctccaggagtaggaaccaatcccaaagtagacagaagagggaagtgggggcttttaggacacagagaaaactaaagactggaagaagaaaaatccaaacagagggagctggagccagagctagagccttctaaccctagtttgggacaggagaataaactatctatatggtctactatttggcctattattagctcggaatagccctagacttgaagtcagtctacacttgcattcaaactgtagttgtgtggccatgggcaagtcacttctgcgagttgcagattttttatctgcaaaatggggaagatgaccatctgtttttcatgagttatgttttggattaaatgcagtcccatgtgtgaaatcaaccagcatagtgcctgacatactgtataaacttaaagaaaacacacagcaggaccacttattgaacactgaagatgtgccaggcactaagcatttcacatgcattaactgatttaatcatctctctaaccttatgtgaaacagttttattattgttattattattaagacagggcctctctggctctgttgcccaggttggagtgcaatggtacactcatagctaactgcaacctcagactcctgggcataagctatccttctgtctcagcctcctgagtagctaggactacaggctacaggtgcatgctaccgtgcccggctaatttttttgtattttttgtagagatggggtttcaccatgttggccaggctggtcttgaactcctggcctcaagcaatcttcctgcctgagcctcccaaagtgctgggattacaggcatgagccaccatgtccagctggtaagttattatccccactttacaaatggagaaccagagatgcataaagcttaagtgattcgccaagagcacatagctaataaccagcagaattgggaatgaaactcagatcctccagttttttcctaggataccacacgacccctcctctccaaggaagagtctatctgaaaaagcctgtattcctgaggtttcccatagcaattccctcaagaagcagtcagcaaagggaggtctcattagtcctagagctgaaaccattccctccataggcagtggggagagagaggaggagaaacaaacagaaaagtaagaaaatgcctacgaccaaccatgcagctctaggccaagatgtgaaggcagtgaccccagtgcttgcctttctcctaaggctggctcaggcactatcaataagcacacacctcatcccatccttcattactccaaaatgcttttcttaggaagcaaaaagaaagagatattgaagaaagaaagcaagagggggaagagtggcagcagccatggctactggctgtacctaccatggaagttgcccagggtggagagatggcttgggagagagcggggtatccggctagctcagactctcgttgacaaaccctccagccagcgtcctcccttagctgggacccatctgccctccagttaagaccttctggggcgagggaccatcagcccaagatgctgagtgtgatccaaggggctcaggcacagtcaggttccagttctaagaacaggaaggagtagcactgaaggcaaggtatgaccatcagcctggatggacctagatatggccacagccttagggaacgaaagccagtgtcaagagctggataggagtgaagacgctgctccaggaaccagccagcaccctggtggcaaagggaaggatgaaaggcacttccagcagcataaacagcccccctgctccctactccaacctcctctgagccctggcccaccccctcggcagctcagaggccaataaggaagctgggcccccagccactgctagaactcaggaaaggagcaaggaaatgatgtttgggaaagataaagcgggtgtctaaaaagaatttttaaaaatacacgtaagtgagagagaaaaataccccagacacatacacttaaaagaattcctgtgcttcctggactgagttgaccccacccagccatctctgcaggtcctctgggccccagaaaagtacagataagccaggactagcagcctccaggtccagaggagtagcactccagctgattttatatagctgggggcaagtgactgagagattttccaaggtgaaggtcctggtgagatacgaaggctcacaaacattttcggatgtatttacaggggtctgcacttcctgtgcggacttgagcagatccaaagaaaacccaattttacaccagagacttcaactccagaaaaggtgcccattagcaatgctggaaatgtggtgtttggggtcagtgtccctggatttgccatgaattcactctgacctctggcaacttactcccactctctgggcttctgtttcctccctgtaaaataaaacattgaattcaatcgtcacaaatgacccttcccactctagcatgctatgatgtagtagtcctaggccccaggctgaggttccaaatgatgccctaagtgattagcgcagtagccagaatccagagcagccctatgtggatttgttgcaccccctaagcccaggctcaggcaccaggatttaatttatcttggggaattagagtcagggttttcctttcattaacactcccaattccctactccagtttcccttggcctctggcctcaattccagtaatttctggctcctgagagggcttatgcaaactcccttaggacatgaagtatgtatgctagggcctttcctctctggggaaatcatgcctggaggccccttcccctttcttccctctgtatctcacaggagagtctgggttgacttttatcaactgtataggggaaagtttgggagctttgaggagcatatggatctggcttacagtctcagctctaccattcactagttgtttggccttgggcatgtcacagaaccttggtttcctcatctataaaacatgcctggcatgtaaaaggcactcaataaatgctatctgtttttaatattacccgtatgcaaaataataatgagcgaggtaccattagcaataagaaaactgatttcttcaatccaaatgaagataaaagagaaaggactagttaagagaaggctcaaatgccaaacccagtacactctggaacagcactctcaaattgtagtgggcatactaattacctggggatcttgttaaaatgcagattttgattcagcgaggcccaggttctgacttttaataagctccagagtgatactgatgctcctggtgtgataaccacattctgagtggcaatataccaggacataatctggtccaaaaaatgcatcaggttaaaatctcttttcatttcattcctcaggcctgggtgtccggccgcccttgctcttctggtcgccaaatgtctttctccttttgctcagtggcccagcccatgcaaacgcttgcctgaagaagtttgccaatccccacttcctaacaaaataaagagcaactggtttgttatcagtgtgaccctgccagtggccaggtgaggctgaagaaattgtgactagaggtgcaagcatgttcatggagctggctgaggtagggagaaagggtgcgaagatgagagttgggatgtcatcagatgaggagtaggcaggtgggcacaaatagtgtatactcaagaaatccttcgttgagggaagatgagagagaaacttgagcggtttagccagtttgggatttggggaagaggttgggagaggtggtggagggaaaagggcatatgctcccatttagcggagctgagttccagataacatgatcaagtatgacctcctgtgctcaggggacggtaaagatgactgcttcttttccaagtactcaggagacgtgaacttggcatgggggcacaggagggtgggcacatgcagcagaaaagccagaagctggctcccaggagaggccttataaaggctcttgtgagaggtgaggggtggaggtggaccaattctgaaaggagtcagtctccagctgcgctagtcagctgtcaccccagtatcttccgatagcaccatctgtctttgagcctggctcccagcagacccctgaagagatacttgggagaagatgagcagaaagagaaccatgactctgctctaacttaggggaaaaaggaaaatgtaacccctgttgcttgtggttgtgctcaacctgaggcctggaccataacagagtgtgggtactttcctctttttaaagtatttatataaatagaagcacaaaataacgtccttgattagctctgtttattttctgtggctcttccagcctccctccaaacagcacattccacctgccccacacgaagaagcccaagctcattctggcaggctcagcaggaagggaagcccacagacaagccggaggacagaacaatgcatggcttgtttatttgacagaagaggggaaaagctgcctggtcaccatggagggacacagagctctgaaggcccacccccacccactgttggctggggtccttgcagcctggtaatcaggaaacccttccttattatagacccaaccaaggggggaagagtgtgtgtgtgtgtgtgtgtgtgtgtgtgtgtgtgtgtgtgtgtgtgtgtaatttgaaagagaactttcaggacaatggctttctcatcagtctgggaaagctataatctgggtcatctgagagatgaatactctctggagaaggggcttttggtacccagctctgcctccctgcctcccctcctctccccacctcctctgaatagccagttcaagttcttccatgtaaatctgctgggtccccctctccaccctccacctcagaatccatccctggctacaaagaaacccagggtagggaataagaaaagaagggaatgttcgagtggaaataaagactccccacaaatgctgtggtgtgtgtcaggggtgctctttgtctttctgcatagggagtgataacttcatctggctagggcattacatttgaccctctgcttccatttctccattttcacattgaaatctttaagacacagggggacacctctttttccaaagaaggttggcaggaagtaaccatacagatgactcgggaaagctctgcacatagcagcgggtaggaaaatgcttagtactttagaaatgcagtactcgggattctctttcagaatgggctagagagaaatttctagtttttctatatatagtgtgataaaacataccagtcatagacttgtttaactgacagaagagggaaaaagctggctgatcttatcaatgatcctaaaggcaaagaggtggatagtgaatatttcgaagcttctaggagcaaggggagcaagtccagaatctgaataatgaaagagtttttttccctctcccttctatgtacagaagttaagggtgcaacaccagagggctaagggagacttcagaggagcacatagggaaaatggcatcaagttcacagtgcaccatctgactcaacagatagccttaaaggttttgccatgatgcccagtttcctaaaccaacacccaaagcgataaagaaggtggaggatgtttgtcctccagctctggtttctatcagtaacatttatagcgtcccttgggaaagaggctgtaggaataataccagttttcttttcttcctccttaaagcccattatccctttcagttcaaactcactgttcgacctaccacttttcagaggtctgatggaatccataaaggttttccccagagtcaagtctcaaaatcctcagaactacttctggccactccccaggtcatctctactactaaagacatggagccctaggacaataaccaacaacagttaggaccccaatagaaacaagaacacccagtcactctgctttgatacaacttgacaatcaggaggagccaagacccagcagagctggagcacagtgagcaaggtggactgcagtgggagatgatactggggaggtgcataggccagatcatggagtttccaaaggctgaaacagtttgaattttattctcagtgaaatgggaagctgttagaggttgttaagcaggggactaacatgatgtaagttttataaaggtttgacttggctgatggatttgtgtgtgtgggggtcaacagtagaagccagagaaccatttaaaggggctattataggtaagagataatggtggtttgttctaggaaagtagcagttgggacaagaacaagagatttgattagaggtattttgaagaggtagggctgacagtatttgttgatggactgaatatggagaatgaggaaaaaagaatgagctatgatacttgagtcacctggcatctgtaccttcttagcacagtattcattcctgaaactgagtcattaggggctctaaaaagaaaattggcagtcttcactattgttttgtccaagcatttacagagctcctctatctacatttaaggtgtttggagaggtactaggcaacatgccaaaatgaagaagaagtaatccctgtgctcaaggaattaagtgtggtagagggtggatgaaaaatacctagaaaaccattaaaaaggatggaatgtcagaagtatcagaaaggaaatgctaacaaaatgagagtcaaaagaaggagagagcactgctgcctgaatcaagaatggcatcacagagcctctgagctgattttggaagagtcaatacaatcaccactgaagatgactgggagagaggccatgccagatttgcatgaacagaagtgagaagcacaggaataccatgaaggaagaaaacacagtttttataaggcacagaggaagtgaaattagaatgattcaagagcatggtgggccttaagagtcaagttaaagcctttacttcacataatccaataagcaagagagagcccttggaagttccagagtaggagagcaatatggtacgagcggtattataggaaagttattatggtagccatgtgtaggataaattatgtggatagatactggaagcatagagaagtgagtaagctaatggaatagacacaataaaaggtaaaatcagagcaatggcagtggggatggagcagaaaggaagaatgtgacagagaatcaacagcgttggactgctaattacataagcagagagaacagatgactgtgaagcacctagaaggctgatatcagtaatctaaatagcaaagtcataggcaagaaccagctttaggaaacatgagtttgatttcagatattagtttgttatgctagcaaattctgtaggtaggtgtgcccagcgagcagcttgatgtgtggactgcagtgctagaaagaggttggggcacggtatggacatgtggtcactatccagaggaggcagccgaggctgttgccgtggatgtgactgcccacggtgaatgtatgcaaaggagacgggggatgatagatctctgcagagctatagttcagtgagaagaggaagaagagctggtaatagagacaaaacaatgaaatgccattttcagtcatattggcaatactttctaaaggtaagtgctgacaaagttgtggggaaatagatatacattggtgggtgggaatggaaatgggtacacacttgcttaagggaattttggcatatgttatcagaagacttaaaatgtttctactgtgcttgctttggctgacataactaaaattgcaatgatacagagattagcatggttcctgcacaaggataatgcacaaatttgtgaaatgctctgtatttttactgcaattagtggtaatggtttcacaaccttgtgaatgtactaaaacccactgaattacacacttgaaatagtgaattttatggtatgtgaattatatttaagaaatttcatatcctttgatccagtttttccactcctaggattttatcctaagaaagccattaaagatgtacacatttatttatgtacttgaagtgtcttccactgcagggttattcataatggtaaaatttggaatatcctagctgtccaacatttaggaagagttagaacatattgtgcatttacatggaggaataatagtttgtcattacaaaccatgtttttgaagactacttaatgatcctgaaaaaggctcacaatgtaatggtaaatttaaaaattgtatataaacctgaacatattacaagttcaattcaagaactatatatgcatatatacatattcttatacagatatgcaaatattgaaaggctggatgtaaatgtactaatattgtatcagtgggtatttatctttgtgtggtggaattaagggttatttttatttttcatacttttaaatcatttctagattttatacaccacacatgtattaccttttaaataaaaagaggtttctttttttgagatggagtcttgctctgttgccagactggagtgcagtggtgtgatcttggctcactgcaacctccgcctcccaggttcaagagatggccctgcctcagcctcccgagtagccgggactgcaggcacgtgccaccacgcctggctaatttttttttttttttgtattttagtagagatggggtttcaccatgttggctaggatggtctccatctcctgacctcgtgatccgcccacctcgatctcccaaagtgctgggattataggcgtgagccaccgcaaccagccataaaaagaggtttctaaagaaaaatgtcaccattctacatggacatatcatttacccaggcaactgtctgatataactgtctgacatattcttaaattaggaatctgcaattatactggtgatttcacttaactatttcaaagatctagatttttccctcagggaaatcagcctagagcccaccaacctagcaaaatgctttttttccacataattttgctgcttggcagtggattcttttgtcttactattttttaaaaattccatctgacagttttttacccttaatattagcactgggagctattctttgctgtgagagtagaccagggctggaagaaccaggagcaagtttgagaggaggccaggcaaaggaaaagagaagtcaagtcaaggtcagtatcaaggccatgcccagtgtgttgaaacaaacaaacaaaccaacaaaaaaacactactcagggccttcctgggtttagttcttttccagctgcctgatagacttggtgggacaaagttggctagagagggaacaaaagtacaagaaaatttagtggtggtggtggaggtgtggcagcaagtaccatttgtaaagccatctaactgctaatatttttatgcaacatttacagttcataaagaactttcatatacaccattccatttcattctcataaccttactaagtccacctcagaaaagaagaaactcaggcttagggaggtgaaataaatcacataaggcttgaacacaagttttttgcatccaaatttctatgtcccccaacccccaaatagtgtttttcaaagttgttctatagaccagcatcagcatcacctgagaacttgtaggaaagaaaattctggggacccatcctcgaccttttggatcagaaactctgggggtggggcccagcaatatgaattttggttttgtttttatactttactttctggaatacatgtgcagaacgtgcaggtttgttacattggtatacacgtgtcatggtggtttgatgcacccatcaacccatcatctacattaggtatttctcctaatgctatccctcccctagccccttaacccccgacatgccccagtgtgtgacattcccctcccagtgtccatgtgttctcattgttcaactttcacttatgagtgagaacatgtggtgtttggttttctgttcctgtgttagtttacctagaatgatggtttccagcttcatccatgtccctgcaaaggacatgaactcatccatttttatggctgcatagtattccatggtgtatatgtgccatattttctttatccagtttatcattgatgggcatttgggttggttccaagtctttgctattgtcagtagtgctacaataaacatacgtgtacatgtgtctttacagtagagtgacttataatcctttgggtatatatccagtaatgggattgctagatcaaacggtatttctggttccagatccttgaggaatcgccacactatcttccacaatggttcaactaatttacattcccaccaacagcgtaaaagcattcctatttctccaaatcctctctagcatctgttgtttcctgactttttaatgattgccattctaactggagtgagatggtatctcattgtggttttgatttgcatttctctaatggccaatgacgataagctttttttcatgtttggccacataaatgtcttcttttgagaagtgtctgttcatatccttcacctattttttgatgggttttttttcttgtaaatttgtttaagttccttgtagattctggatattagccctttgtcagatggatagattgcaaaaattttcttccattctgtaggttgcctgttcactctgatgatagtttcttttgctgtgcagaagctctttagtttaattagatcctgtttgtcaattttggcttctgttgccattgcttttggtgttttagacatgaagtctttgcccatggctatgtcctgaatggtattgcctaggttttcttctagggtttttatggttttaggtctaacatttaagtctttaatccatcgtaatttttgtataaggtgtaaggaaggggtccagtttcagttttctgcatatggctagccagttttcccaataccatttattaaatagggaatcctttccccattgcttgtttttgtcaggtttgtcaaagatcagattgttgtagaggtgtggcattatttctgaggcctctgttctattccattggtctatatatctgttttggtaccagtaccatgttgttttggctactgtagccttgtagtatagtttgaagtcaggtagcatgatgcctccagctttgttctttttgcttaggattgtcttggctatccaggctctttttttggttccatatgaaatttaaagtacgtttttctaattctgtgaagaaagtcaatggtaacttgatggggagagcactgaatctataaattactttgggcagtatgaccattttcacgatattgattcttcctatccatgagcatggaatgtttttccatttgtttgtgtcctctcttatttccttgagcagtggtttgtagttctccttgaggtccttcgcatcccttgtaagttgtattcctaggtattttattctctttgtagcaattgtgaatgggagttcactcatgatttggctctctgtttgtctattattggtatataggaatgcttgtgaattttgcacattgattttgtatcctgagactttgctgaagttgcttatcagcttaaggagattttgggctgagatgattgggttttctaaatatacaatcatgtcatcagcaaacagagacaatttgacttcctctctttctatttgaataccctttatttccttctcttgcctgactgccctggccagaacttccaatactatgttgaataggagtggtgagagaggccatccttgtcttgtgtgggttttcaaagggaatgtctccagcttctgtccattcagtatgatactggctgtgggtttgtcatatatagctcttactattttgagatgtttcatcaatacctagcttattgagagtttttagcatgaagggtgttgagctttatcgaaggccttttctgcatctatggagataattatgtggtttttgtcattggttatgtttatgtgatggattacatttattgatttgcatttgctgagtcagccttgcatcccagggatgaagccgacttgatcgtggtggatcctctagatgattctaatgcacgctcataagtttgagaaccattactgtagcatacattttaaaacagattttcaagtgacttctaaatacgggctgctgctattttggctcttgtggggtgctgctttccaaggtaggctggaagcctacctttagctatcagtgctatgtgtataatagagggcagctgcttaaaaagtatttaggttccagggacaggaatgttcttctttagggtgaggaagctcccaggaccaagagggcaattcttgaatcacagctgcccttgtcagggggagataagtgctggtgagcagttgccatatatgtacttccctggtaaggcttcttttcattaaggcttttgtctggttccacaatgttcacataagcccttgggaaatttctctttctgaggtatttacattcacaaacctcaagttcatcaagctgttcatttcattttgcatagctttattaaggtttagttgacaaataaaattgtacacatttataatatacaatatattttttcatacatgtaaacattgtgaaatgattaaataaagctaatttacatatccataacctcaaatacttatcattttttgtggtgagaacatctaagatctactctcttagcaatttaagtatacaatacattattattaactacagttactattctgtatattagatttccagaacgtactcctcttgttcaactgaagctttatagcctttgatcaacagctcatttcctgccccacccgccccattcctggtgaccaccattctaccctctgcttctatgagtttgatgttttactattataattattatttttaatataatttcaacctctatgtgagattcagggggtgcatgtgcaggtttgttacatgggtatattgtgtgattctgaagtttggggtatgaatgatcccaacacctgggtactaaccacagtacccaatagttttccagtccttgtccccctctgtccttccctcccctatctagtaggtcccagtgtccattgttgccatctttaggtccatgagtacccattgttcttacttataagtgggagctaaacatgtggtatttggctttctgttcctacattaatttgcttaggacaatgacctccagctctgtgtatgttgctgcaaaggacgtgatttcattcttttttatggctgcatagtattccatagtgtatatataccacattttatttatccaattcaccattgatgggcacctaggttgattccatgtctttgctattgtgaatagtgctgcaatgaacaaacaagtgcaggtgtctttttggtagaaacatttattttcttttgtgtatataccaagtaatgggattgctctgtaagagttcagcttttttacatttcacatatgagatcatgtggtatttgtccttctgtgcctggtttatttccttagcataatgtccttcagtatcatccatgttgtacaaatgacaggatttccttcttttttatggctgtatagtatttcattgtatatgtgtgtgtgtatatatatatttcatatattttttatatatgaaatatatattatatataacatatatttttatatatgaaatatatattatataacatattttctttattcatcatctttattcatcataaagaataaattcattctttattcattcatttataacacattcattcaagtgttgttggacacttagatttattccatatcttggctattgtgaatagtactgtaataaacatgggagtgcaaacatctctttaacatactgatttcatttgctttagatatatacccagaagtaggactgctggcttatattatagttctatttttagttttttgagaagcccccctactgttttccataatggctatactaatttacatttctaccaatagtgtataagggttcctttttcttcacaccctcaccaacacttgtctttttgattatagacattctaacatatgtgaggtgatatgtcactgtggttttgatttgcatttcactgatgattagtgacgtcaaacatttttttaaatatacctgttgaccatttatatatcttcttttgagaaatgtctcttcagatctttggcccattttgtaatcaagttatttgttttcttactattgacttgtttgatttccttatatgttttggatattaactccttatcaaatatgatttgcaaatattttctccaatcctgcaggttgtctctttactctgtggattgtttccttggctgtacagaagctttttaatttgatgcaatccaacctatttttgcttttgttgcctgtgcttttagggccatagccaaaaaatctttgccaaagccaaatgtcaaaaagcttttccatatgtttccttgtagtagttttagagtttaaggtcttatgtttaagtctttaatcaattttgaattggtttttatatatgatgtaggataagagtccaatttcattccgcatgtgaatatccagttttcatgacaccatttactgaagagactgtgctttccccattatgtgttcttgacacctttgttgaagaccagttgactgtaaatgtgtggatttatttttgggctctctcttctgttccattgaatggtatttccgtttttatgccagtaccatactgttttgattactatagttttgtagtatatttgggatcaggtagtatgatgcctccagctttttttttttcctcaatatttcattagctatttggggtcttttgtggttccttacaaattttagaattttttattcctgtgaaaaaatgtagttggaattttgatagagattgcattcaatctgtagattgttttcagcagtatggacattttaatgatagtaattcttctaacccatgaacatggaatatctttattttttatttatttgtcttatttattgtgtcctctttaatttatttcatcaatattttatagtttttagtatacagatttttacctcattgattaaatttattcctaagtattttagatttattttgatgctattgtaaatgggatcatttttaaaatttctaagtttgttgttagtgtatagaaacattattgatttttacagggtaactttgtatcctgcaactttactgaattcttttattatttctaagagccttttggtggacttctagggttttctgtataagatcatgtcacctacaaataaagacaatttaacttcttccttttcaattgatatggcttttatttctttttcttgcctaattgctctggtaggactttcagtactatgtttagtagaagtggggaaaatgggtgcccttgtcttgttccctattttaaaggaaaagctttcagctttccaccatggaatataatgttagctgtgggcttctcatatatagccttattgtgttgaggcacattccttctacacctaatttttggacagttttttttttttatcatgaaagcatgttgcactttgtgaaattctttttttgtatctattgagatgatcataagacttttatccttctgctaatgtggtatatcacatttattgatttgtgtatgttgaactatctttgcagtaaggaaataaggaaattcagtggggaatgggttgcgaaggtgggggtaggtgaatctatgttcctcagaaggaaaataatatagcattatggtatgttaacaatgttcccctgaagtgtagaggactcatttttcattgtatatgcctttgtactatttgaatggttttccttctgcaagtattgctttgggaaaaaaaaaagaaacacttaaaaatcaacttttacaaaaccaaactaattcttttttgctatggtttaaatatgtatgtcccttcagaattcatattgggacttatctcccaaggtgatggtattaagagataaggccccttgggaggggattaggcattgagggctctgccctcagggatggtattagtgcccttataaaagggtttgaggaagagtttgcctcttttgcccttctacttcttctgctatgtgaggacacagcatttttcccctttgctttccttctatgtgaggacacagcaacaaggcaccacctttgaagcaaagaatagccctcactggatactgaatctgctggtgccttggtcttgatttcccagcctctagaactgtgagaaacaaatttctgttccttataaattacccactctaaggtattttgttgtggtagcataaacgaactaagacaccttcccactcttctgctggtgctggtgacaggtgacatttactaaggtgagaaatctggtagatactctggactccctcctcttatttacccctcaaatctgtctaatcaggcaccaagacttattgattctacctcctagactatataattctcaaatctgcccctccactctatccctgaatcactttaactatagcattcattttgtaactggttgacctgcctcttttctccctgcaaaatgccaatgaatacatcttttcagagtgcaaatctggtcctgccactctcatgcttaaaattcttcactggcttcctagtacttatgggaaaagtccaaattcattagcttggcagcctagaccttccttgttcttaaccactattctaacctccctcctctacaggtacaggtagagggataggaagggaagatgatgaacctgaaattgataataaaagggaaagcctcccagaaatccttcatgaccaagaagagtgctgagggccaggagagaacttaggacaaagaaaaaccatgaattagccatggggagatctggagaagcagtccgcaggatactgcatccatgttggggagcagaggagtctacaaggaatgtgaatgcacagcattcaggcaggaatgctttgatgctggggacatttcttatggaacactgaaggagcatgaaacttgaggtattctgacatgcataatacagaatatataatgtctactaacagtctgcatccagggggaaatccaaattgagatctggttgtcaaggaagggtagaaattcactcagatgaaaggtacttctagagaaggaatagcatattaaaatcatggaaatgaaaggggaacaatggtgtcctgagggtaggatatatgaggaagagaagtggtgaacagtaaggccagacaggcaaactgggccagaacatggagaatagtaaaatcagattcacattttggaaagatgtgtccattggcattttgtagggagaaaagatgcaggtggatcagagaggaaatgaacactatagtccaagtgatgtataatgcagggatagagtagaggggcaagtttgagaaatgtctggtctaggaggtaaaatcagttagtcttggtagctgatgagacagatgtgagggataaataagagggagtatacagtgtctattagatttttcactctagtttatgattcagcctgtcgctagcatcagcagaagagtggggaggagaattagttcggttttagaaaaattgcagtttttaagtatttttaaattatttaaagcaatacttgtagaaggaaaaccattcacatagtacaaaggcatatacaatgaaaaaggagtgccccatactccaggggaaaccacttttaacagtttgttgtttatccctgagcagcaatatggcagagtgtgaagaacataagctctagaacaagactgtctgtatttgaatctaccatttccagctgtatgtccttgggctagttatttaacctctctgcctcacttacattatctctaaaatgggaattataataatgggacacagaaaaggcaggttataatactgcttggaaccttgccgtttgtgcttaacgatatatactggagataattccgtatccacatatacttttcttaaataaattttaaataactgaatagtatttcaccaagtgaactttttatagtttatttagcctttactcaagtaatgaatactgaagttgcttttgctaagacaaataatgttgtgattaatacctttttacatgtcttcacacacatacatgattatatattttatataaagtcctacaagtggaactataggtcaaaaagtacatcaatgtttaattgtgataaaatatactaagatccaaagaggttatgctaatttatacttccaacagtgtgtcagagcagtgctttacgaagtttcatatacctacaagtcacctggggatctgattaacaggcagattctgatttagtagatctggggtggagctgaatttctaaaaagctctcagttgatgcagatgctgctgatccaaggaccacactttgagtagcaaggtataagagcacatgtatttctccacatgcctgccccccaaaaaatgtacattaaacgctctgatttttcccattctgataggtgaaagttacatcttattgcttaaattaatctatactgctttaattgtaagtgttgagcttctctctctctctctctctccctccctccctccctccctctctctccctccctccctccctccctcccttcctccctccctccctctctctccctctctctctccctcttcccctctccatctctgagttagggtcttgcactgttgcccaggctggagtgcaggggcgtgatcacggctcactgcagacttaaactctggctcaagtgatgctctcgcctcagccttctctgagtagctgggactacagggcgtgcaccaccatacctggctaatttttagactttttgtcaagacagggtctcactatgtttctcaggcttgtcttgaactcctggtcacaagcaatcctcctgctttggctacccaaaatgttggaattacaggcatgagacactgtgccaacagagtatctttcatttgtttttataagcccactttctttttgtctgaactgcctgttcaggttcttttttccttttttgaatggtttgttggcattttcctgttattctcaagagctctttatatattatatattaagggaaccagcctcttgccatatcagatgcaaaaccttttccccagtttttttctttggattttatttttgtatttttcgggtgctttaaatttcaactttcgtgttgtcagatttaacaattttctcttttatggcttccaggtttttttgtttggttggttgttttttgtttttgtttttgtttgagacagggtctcattctatcgcccaggctggagtgcagtggtgcgatctccactcactgcaacctctgcctccaggattcaagtgattctcatgggattacaggcgtccaacaccacgcctggctaatttttgtattttttgtagagacggggttttgccatgttgcctaggctggtctcgaattcctgagctcgggtaatctgcccgcctcggcctcccaaagtgctgggaatacaggcatgagccaccgcacccggccagcacccaggttttgtgttttgcttagaaagacttttcttatttaaagataagatcatatactaaaagttatatactaaacaattgtctttgaatcatggttagacttcattacggtttactgatcagtctattcatgtgcttagtaccaaagtattttaattactgtaattttataatatgttttaacaggactagctgctttgtcttttattcctcttttattcagacctttcctgactagtcttacatatgtacttcagaatcagtttgggcatgttggattgtaatgcgtctggaggacaactccgtgtgtagaaatttaacatgcagttgaaaatgataatctggaatctgggcatgtgttcttccctagatatagaaatctgggagtcatcagtggtacctgaagcccctcaataaaagttcatagaataagaaaatgaggctgagatagaactctaggttagtggttctcaaaattcagtccccacacccgcagcatcagcattatctgagaacttcttgagctcctactagatcagaaactctggagacaggggaggagcagtatgttctttaatataaactctccagggaaatttaacgtatgttcaaatctgagaactactgttctagggtatatctgtggataagacaaattaaggaaaaagagctcaagataactagtagtaggaaaacaaggaaaaagaagtgttatgcgtcaggcgtggtggctcacacctgtaatcccagcactttgggaggccaaggtgggcggatcatgaggtcaggagttcgagaccagtctggccaacatagtgaaagcccgtctctgctaaaaatataaaaaaattagccaggtgtggtggggtgtgcctgtaatcccagctacttgggaggctgaggcaggagaatcacgtgaacctgggaggcagaggttgcagtgagtggagatcgcaccattgcactccagcctaggtgacagtgtgagactccatctcaaaaaaaaaaaagtgttatgataataaaagaaaacaaatttctagaaagtgctcaacagtgcccaaagctgcaatgatgaaacaaaataatatttattaagcaactactatttccaaagggcttatgtatatcagctcatttactcatgtaataaagtaaatatcattatccccattttacagaaaaggaaactgtgattaagtaacttaccaaaggtcatctagcttatatgtgatttgacaccagttctaccatataataatggcttaaaaacttactgaaaaattgcacattagaaaaggagaagaaactacgctccttggattttttttcaatctggaagacattaattcaccttggaaccatacagaggacagtggcatagtagtggtaggagtagaaggcagactgtagtgaggaaatgggaggtgagaaaatagagccaatgtctaagatgtttggctgtgaaggaaaagaaattggtagttggatgagggtaaaggttaagggcagattatgtttttaggatgaagagaccacctgcaaatatttatgtagaatttagattaatttagattagaaatttcattctaaggctccaggacaatctctagtcctgacctctcacttaaataccacaccagttctacctactccctacaactgcccactggctttctatatcttctatcaccccaaactaaaaacaacaaaaaccaaacaaaaattgatgccaagcctagctctttctatttttgttttgtttgttcattttaaatccttaaaggtctgactggctcaaacctggtaatcattgtgtactcctcctcttcttcagcctttatactgaattagtcaccaagtgctggctttgaaatatcttcacctattaacttgtcctgtctattcctactgtcactgctccctgtactacataagcaattgtgtagcatgagctccttacatccaatccaacccacaccaattttccacaaattccaatctcatacttattcatctgcttgcaatcctgcagtggttccccatggcctactaagtaaagcttgctttttctgggccttctatagattgttcacatttatctctcactgatcccctatataaatcttaagttggatggacctcctttatgtttcccaaaactacgtttctttccatcccttttttatgcattcctatgaactatttaggaattaagcaaagctccccctcttgtttgcaagcatagtgttatgttttcttcctctaatcttcaaaatcacttgctgctggcatcactcattttgataaccacgtacttccctgctcaagcattttgcctatgtatgtcttatctctctcaactagagtacagggctagagcatactccttctatgatcaccaccacattgcttaacatacatgctcagcactcaaaaatatttgttaaatcaatgaaattgtatcatgagaccttgccatttgaagagatcattggtgaattaattttggaaaatgcctttttaaaaaactctcaaatgccatattaagaacaacaatacacattcactgactatgtacccagtatcaggtactttctcttgaagtacctatttaattcttaccagatccctgtcgggtgaaggttattactctgaaaccataaagagaagactatgacatgtttaaagacttgcccagtatttctactacttctacagagtactcacagcctgcattcaaaacccccaagtccattgctctattctccacaacacagattttttctttcatttttattttttaaacaggatcatattgttcttacttgaattaaaaagattatttttctgtacttttgatatgaaaattctaattaagaaaataggtaaataatgagtatatttttatctcaggtttagtgtctaattacagtttctgtcactaatgagagaaagtacctttgtgtccccaaagtaaacttgtaccataatgcaaagggagatgagatgcagctgggtgttgcattaacattcataattatgcatcatatgttccagaaatgaattgttgtttgacagcaagggaaatgacaatagtaagaattatagcaaaagcacataaggttaatcaacatataatcgactctcaaatatgcacattttgcatgttttcttttattggtgtttatgatttactatttagaaacaactgtaaattaatctactagaatatatttccctattaaagatgcctgaattgaaaacatgcacatataaagtgaatacatttttaatgacacatagtagatatattacttaagggagattttgctccacaaatgcaataacctacacataatgaggtgttctccagcaatacttggtctaaaacacacaacacaccacaccacacacaccacacagacacacacacacacacacacacacactttggggacaatttaaacctattgggagaaaaagactagattaaaaagacatactgaaaagacacttttcagcatctcctaatgcatacattattaaacatagcataccccaaggaaacaggaggaatgcagaatacaaatgacatttttccactgactgagacctagcttcaaatcagaaaagaggatgccttcacccaacagatggctactaatgtcttaacgttaggagccaacaatcatcactttagttgcaagcagacccacacctagaaccttaaccctcatccaatcaaagagctaattaactcagtttattcttctgtgaagactggtgagcatctcaggtcgaggcaaagttaaagcctgggtaacttagaaatcctcaattatcctctcagatcaatttacaatttctttttctctgggctttactggggtgtcaaggttactactgaggataacacagggtgaggcaagggagaaagcatgcacaacttgatttttaaactcaaataaggatttctgaagaacccagtcaaaatatttcatttaaagcctctgaaaataccgctgagacagaggtaggtaggtacatcagtaggaaccaattgaggtgctacagagagcaaactagatatgagcaaactagatatgaagtcagatagatctggctgtgagacagtggacatgtcagttacttcatttcttcgtacctcagtctccttatctgtaatgtggggatgtatttatccctacacctcataagagagctgtgccaattaaatgacatgatgcatttgttagctgctagcactgtatttcacccaccgtatgtgctgggatagagggacagaactaacatttacggagtgtctattaaatctgaaagtaatcatggttctggccaagcctctaagttaggtgggaaggcatcatggaagaactcttcattctggattgaaatccctaaggataattttgtttatcttttcctggtcttaatattttcagaccaactgttgggccaaggactgatatggcactatcacagtgagctgtagaattacgatactcctaatgaatggaattctccaaaactcagccccgtttatacagggaaaatagatgggatctggagtcaaacacagagactgaatttgagttccagctctgacacttactagctttgtggtcttagacaactgacatgtccatttgagccttggtttgctatcactattgtattccatgatggcatgaggtctcaggccaagcaagctactcagatcctgggatacaacacacaggcaacacagagctactttcccagtctagctgggacaaaccaatggtcattgcaagcttttaccctgatgagttatggggaggggaaaagaaattatttttatggtgataacttactgtggcgtgaaaggggcctctagcaattcttcttgttctaggaaattcatcataatagtgattctgaatcacatattatagaccagccatactcttcatcacttcatgagcagcctctcctactcatccttaaacttttcctttactcaactccaggcctttcccaggaaatagaaagtagaaaagaatcatacacaggtacacatactgagagagagaggaggtggggaggcaggaatataacaagagaaacatttcttaatctcatacaaaatgcatacaccaaaacaagtttttaatttttgttcaaaatattccattcttttggaagggccatgggtactttaagaaatatctttctgaagtgcaaagagggaaaacctcaggtaagtaaccttcaatgtgtgtaaatttaaatcaagcctttttttatgactgagagaagggcaggtgatgttctactctttcccccagaggaaaaaaaaaactaccatgtataacttctcaaagactattcaaaggcattcattaactttatacttaacaaaattgagggatattctacaccttcatcacagaaaaaaggaagaatatatctctgcattaggagccagagacaatcatttttagctgaacaagggtgccagaacagccaacccatgctttccctttgattagctggaaagcaatcaatgcactcttgttagattggagctctcactcaggatagaaactggcctgatgtccaaaaagtcggcagttcagagactaatccccagaagggatcttgacatttgcgctaagatccagagttggcatgcttatcagaacccaagtttaagactgaggcttgaagttgttaagtaatagactggtgaggcatattcaacatcttcaaaattcacacgtttatttcatcagctgaaacaaacagcttaggtacttaaggtttgcttcatttagctgttttactaaagatattgggttttaaataaatatatttatttaactttaaaatttattaaagatatggggaggtaatacttataaatcttaggattgggggcaaaaacattatttattgagacttctgcttctgggaaaatggagatgaactttctcccattcctttcactaatataactagaacccttggacattatgtataaaacaaacataagatgactctcagctgactgcctctgataccattcattaggagaaaatatttgcaaaacacatttctgacaaaggactagtatctagaacatgaaaagaaatttcaaaacttaggagtaaaaaaaatctagttagaagggtgttaatgtaatgaaaatgatttctattacattaagaaggcaaaccagtgagggaccttgagttccaaggaatgacacagtgataaggtctctggcttttctttttaccttctatagcccagatttggagctgagaagcaacaacctggaaatacttgtgggcacggaccaaatataagccccaataagagcctgctctcactatccagaggactgggagaggggtagacaccaagacataaaacttttagataataactgctctactccagtcaaacagcacaggaaaactgtggccccagccaccctcatgccaatgaaggctgagtggggagcctagacttccactctgactaggctattaataaggtgtcgcaaatctcctcctccaggtgttggtaggaaagaccaaatacagagacaggactttcatccatgccaggtgataacaagtctcctactcatgatgttaatggagaacacatggggagcataggcatccgctccccgcttggcggtaacaaggagcccctcctcccagctgaggtggtgttcagaggcggcctagtggggtgttagaacctccaccactgcccagcagtaagcaagccactccccttctctgtggtgtcagaggcactcccagcaagggagatatcagtgaaagcctagcagaaacaagcagcctccctcctcaggtgtcaatagaggccaagtggagagcctggactttctacctccacatggcagtaatatggcagcaacccccatcacttgccagagtggtgtcagaggaagccagctaaaacaagcttaaatatgattcagagtctcaaaacataatatcctaaatatccagatttcaatgaaaaaatcattcatcatgctggaaccaggaagatctcaaactgaatgaaagagagataatcatgagacaccacaagatcacagaaatgttagaatgatatgataaagcacccattataaaaatgcttcaatgagtaatgacagacatgcatgaaacaaatgaaaaaacagaaagacttacaaagaattagcaagtcttggcaaagatgtagaatatataaagaagaaccaactggaaatcttagaacttaaaaatacaatattcaaaataaaaaaacaaaatgaatacaggcataccttggagatattgctttgattccagaccactgcaataaagcaaatactgaaataaagtgagtaacatgaattgttttggtttctccatgcatataaaagttatgtttacactacactgtagtctattaagtgtagaatagcatcatgcctaaaaacaatgtacaaaccttgatgaaagaatactttattgctaaaaaatgttaatgatcatctgcgtcttcagtgagtcataatctttttgctggtggaaggtcttgccttgatgttgatggctactggcttctcagggtgatggttgctgaagattggagtaggtgtggcaatttcataaaataagacaacaacaaagtttgctgcatcaattgacccttccttccctgagagatttctctgtagtatgccatgctgtttgacagcatttaccgacagtaggatttccctctcctctctcctctcttctctttcagagaattgctctgtcacccaggctggagtgcagtggcgtgatcacagcttactgcggtctctacctccctgggctcaagcaatcctcccacctcagtctcttgagtagctgggacttcagacatgccaccacacccaactaaattttttttttgtagagttggggtttcactatgtttcccaggctgatcttgaactcctgggatcaagcaatccacatgccttggcctcccaaagtgctgggattacaggcgtgagccaccgtgcctggcctgacttctttcaaaattggagtcaatcctctcaaaccctgccactattttatcaactaagtttgttgaatatcctaaatcccttgttgtcatttcaacattgttcacagtatcttcaccaggagtagattccatctcaagaaaccactttctttgctcacacataagaagcaactccttgtctgttaaggttttatgagatggcagcaattcagtcacatcttcaggttccacttctaattctagtactcttgctattcctaccacctttgcagttacttcttccacagaagtcttgaacccctcaaagtcatttatgaggggtagaatgaagttcttccaaactcctgctaatatggatattttgatctcctcccttgaatcatgaatattttaatgacatcaaaacggtgaatcccttccataagattttcaatttactttggccacattcatcagaggattgtctatggcagctatagccttacaaaatgcatttctttttttttctttttttattattattatactttaagttctggggtacatgtgcagaatgtgcaggtttgttacataggtacacatgagccatggtggtttgctgcatccatcaacctgtcatctacattaggtatttctcctgatgctatccctcccctagccccccaccctctgacaggcccctgtgtgtgatgttcccctccctgtgtccatgtgttctcattgttcaactctcacttgtgagtgagaacatatggtgttttgttttctgttcttgtgttagttttctgagaatgatggtttccagcttcatccatgtccctgcaaaggacatgaactcatccatttttatggctgcatagtattcaatggtgtatatgtgccacattttctttatccagtctatcattgataggcatttgggttggttccaagtctttgctattgtgaacagtgctgcaataaacatacgtgtacatgtgtctttgtagcagaatgatttataatcctttgggtatatacccagtaatcagatcactgggtcaaatgctatttctggttctagatccttaaggaattgccacactgtcttccacaatggttgaactaatttacactcccaccaacagtgtaaaagcattcctatttctccacatcctctccagcatctgttgtttcctgactttttaatgattgccatttgaactagcatgagatggcatctcattgtggttttgatttgcctttctctaatgaccagtgatggtgagcttttcttcatatgttttttggccacataaatgtcttcttttgaggagtgtctgttgatatctttcgcccactttttgataaataataagacttgaaagtcaaaattactccccaatctatgggctgcagaatggatgagttagcaggcatgaaaataacatgaacctccttgtacatatccatcagggtgcttgggtgatcaggtgcattgttaatgagcagtaatatttgaaaggaattttctgagcagtaattatcaacaatgggcttaaaatattcagtaaccctgctgtaaacagatgtgctgtcatccaggtttggttccatttatagagcacagacagagtagatttagtataattcttaagggccctaggatttttggaatggtaaatgatcaatgacttcaacttaaaagtcatcagctgcattagcccctaacaagagagtcagcctatcccatgaagttttaaattgaggcactgaattctcgtttttagctatgaaagtcctagatggcatcttcttccaatataaggctgtttggtctacattaaaaatctgttgttcagtgtagccaccttcgtcaatgatcttagctagatcttctggataatttgctgcagcttctacatcagcacttggtgcttccccttgcacttttatgttatagagacagcttctttccttaagcctcatgaaccaacctctgctagcttcaaacttttcttctgcagcttcctcagcattctcagccttcatggaattgaagaaagttcaagcctttttctgaattagggtttggctaagggaatgttgtggctggtttgctcttctatgcagaccactgaaactttctctatatcagcaataaggctgtttcactttttttataattcatgtgttcactggagtagcacttttaatttcctttaagaactttcctttgcattcacaacttggctgttcggtgcaagaggcctggctttcagcccatcttggcttttcacatgccttcctcactaagcttaagcatttctaactttttatttaaagggagagctatgtgacacttcctttcacttgaagactcagagggcattgtagggttattaattggtataatttcaatgttgtgtctcagggaatagggaggtctgaggagagggagagtgatagaggaatggcctgtcggtacacacgacatttatcaattcagtttgccatcaatttgacagtttgacatcaattcagtttgccatcttatatgggcacagtttgtggtgccccaaacaattacaatagtaccatcaaaaaatcattgattacagaccatcataacaaatatgatagtaatgaaaaagtttgaaatattgtgagaattacatgtgacacagagacatgaagtgagaacatgctattggaaaaatggtgccaatagacttgcttgacacaggttgccacaaaccttcaatttgtaaaaaccataattatctgcaaagtgcaataaagcaaagtgcaataaaatgaggtatgcctgtaatctcaacagtagaatggagaagacaaaagaatcagtacagttgaagatagaaaaatataaattacccaatacgaacaacagaaagaaaatagactgaaaaaataaacagagcctcagggatctttgggaccatgccaaaagatctaacattcatagtactgaagtactagaaggagagaagcagagcaagactaaaaatatacttgaacaaataatacctaaaacttccccaaatttggcaaaagacataaacctgaagattcaagaaggtaagaaaatcccaacaggataaacccaaagaaattcataccaagacacatcttagtcaaaagtctgaaagctaaagacaaacaaaaaaatcttgaaagcagagagaaagaagtgacacattactgatatgtgaaaaataatttgaatgacatcatatttctcatcagaaatcaatggagccagaggaagtggcacaatatttttttcaactactgaaagaaaagaactttcaatccagaatcctatgtcaagagaaaatatccttcaggaatgaaggagtcatcaggacattctcagatgaggcaaaactaacagcattcaccactggtggacctattttaaaagtacggctaaaggaagttctgtaaatggaaaggaaatgacaaaagaaggattcctggaatattaggaaagaagaaatgacatagaaaatatgtatgtatgtatatgggtaaataaaatagatttcctttttctcttgaattatctaagttatgtttgatggtgaaagcaaaaattataacattgtctgatgtggttctaaatgtatgtaaaggaaatatttaagataattttattgtaaaaagagaagcataaagagatgtaaagaaaggtaaagttactatacttcaaactggtaaaatgacaatatcaataaactgtgatacatgatgtatatctaatacctatagcaaccactaaaaaatcaatatgaagagatatactcaaaatctctaaagataaatcaaaatgggattctaattaatgtttaagtaacctactgtaaggcagagaaaaaagaaagtaaagaaagtaaaaaagagaacaaagagaaaacaaaacaagatttaagccctaacatattaataagtatgtgaaatgtaagtggtctaaacacatcaatgaaaagacagagactggcagagtgcataaaaacacatgattcaactatatgctgtcaacagtaattcacttcaaataatataagcaggttgaaagtacaaagacaaaaaatatactatgtagatgtgaatgaaaggaaagagagaatggctatattaatagcagataaagtaagcaaccaaagaaataaatggcattcagatttggaaaggataaaataaaactgtcgctttttggagataacatatgttgaaaatcccaaagaatctaaaactaacaaaatcaatcagtcaaacaaacaaaacaagttcagcaagtacgaagcatacaagatcaacataccaaaagcaatcacatttctgtatacaaataatagacatgtgaaaacaaataaaaaacaataccatttacagttgctgcaaaaaaatgaaatgcttagatgtaaatctaacagaacatgtatagggtatgcatgctaaaaaccacataatgctgaaaaaagaaaaaaatccaaatgaataggaagacacactgtgttcatggattagaagacgcaatatagtaaacatgttaatcctctctaaatgtttatacatatttaatgcagttcctatcaaaatctcatcaagatattttcttgatatagacacaattgttccagaaaggcagagcaactaggataaagcaattgtgaaaaagaagaataaagtaagaatcaatatacccaatttcaagactttgataactatagcagtcaagactgtatggtattggtagagggtcagacacatatatcaatggaatcgaatagaaaacacagaaataggcccacacaaatatgccaaacttatttttgacaaagttgcaaaagcaattcaatggaaaaaaagatagccttttcaacatatggtgctgtaacaatgagacaacaacaggcctaaaaacaaacctcgacctaagtctgatacttaaacatgcacacaaaacctcagaatggatcatagacttaatgtagaggtaatgtaaatgtaaaactataaatattttagaaaaaaataggagaaaaaatttgggatctaggacattgaaaatagtttttagacttgacaccaaaagtatatattaattcatcaaaggaaaaaccgataaattggatttgagttacatcattcattccttcattaattgttaacatagactatcatgttgtggatactgagactttacagataattaaaatgcagcccctgtcttcaaggaaatcatagtttagtagagaaaagcaatatctaaactaacagttatgatgagatgtggttaagtgcacagaggacggagctctcctgtagggatgaggaacagtttgtaatacatagcagaaacctttaacaatgagcagagacttagcaggtaaaggagtgggacactattctaagcaaagagaacagtatctgcaaaggcagagacatgagaggacactgtattcagggaacggttaatatgttcaaggaggctaaatgtatgagatttgtccatacgttgtcatcatttagagaggggaacaacacacactggggccttttggaaggtggagggtgggaggagggagagatcaacaaaaataactaatgagtactaggcttaatatctaggtgatgaaataatctgtataacaaacccccatgacacaagtttacctattaactctttacctatgtaacaaaccttcacttgtacccctgaacttacaataaaagttttgaaaaatgagatttgaatgaatacatatctgaggtagaaccaacaggatttggtaactgatttgataaaggtgaagtgggtagctgagagaagaggggatcaagatgcttcttgaattcctactttaaaggactaggaccattaaatgtgatcaggaacaggaaaggaggagagggcattcttgtttctggatggggggaaagtattaaaacatattgagtttgaggtacctgtgtttcttggcaaaaatgtcctccagacaactggaaatatgaagttagtattgagaaaatagttctggactagagatgtaaatgtgtgaggcatcagtattcaaatagttgatgctatagtagtaaattatgttacatactgaaagggcacactgagaagctgggtgtctgagagacaaaaaaaaattgatagagcaaagtccaatgttcctttttgactatttgccattcggtcttcacaaaactagtttagattcccctcaatgcattaacatttagagaactctggcttgaataagacaaagagatgaaaaggctgccatttctcagccattgctgccaactcccttctcttctatctccacatagcatctctggggaggtaaggatctgctgaagtcagtaaagaaaattccatagctttctttggtgatttattactgactgcagaaagtgatttagttctctagaagacctagctaaaatccttcctgctacaaatgatactgtttcttcatgtgctgtcttaatggaaaaagaagacagttagataccctattgtgtgtatcatggaattatgttttccagtctggacagcatggggaagtagatttttcaagacaaataaagtggctgatgggaggccctagggttgacagggaaaaagatgtggataagattatgggattcaattcctggtattctagaaaagtagttttttttttttctagtccttgaaagcagttattaaatcacttcttcttgtcttacaaaacaaatatatgaagaatcaaatacacagcttatttattttgcaaggcaaaactcccctatggacattaaattggctgtgaaatgagttaagtcggcaattttgctttggttttgttttgtttttgtgtttgaaaccatccatggcaagtggctatttctaagggcttgaaaattttatcttctctgggttgaataatcttgattctttcacaaagccttcacttgaatgacttttctatccattaattattttatatcacttccttgattgctcaccaaattctttgtacccatctttagctattatgataggatcactttaactctctgatcaaaaactgcgtttaaatattgttcaaaacattctgttctgtgcaagggatataagcccttgaaaaaaacatttcagagaaaaaaaaagtgtcaggccctgttgttaaaggaagtgagctgtaccggaatattaatcaagtccagttattgtatccaaattaaactggtgtctcttaattccagcttgaaaagcagcaaagtggaaggaagaaaagtaatgcaaaggataaaaatagaaaatatttcctgcttaaagaaagagagaaacgggatttttacatacatagtggcatcacttccttaatgaagctattcccttttctataaattctgtctggtgtggaaggacaaagaatggtggaaggaaatctgaaagcaaagatgttgaacaggtaaagttggagtttcccactagttagctccaatagtcaaggctaggggaacatatcaatggccaacacagtatgaattatagttaatccctgagaatggcagacttgagtattttggatactaagggaggcccaaggatgaaaacatgcttctagagaacattttcattttatttgaatttaaattaagatttgggatgagctgataaaaggcaaagtgaaggagtatcatacctggtagtgccttagctgtttattgtttttaaaaattgttctacaattgccagtggttttggttaatgtcaatctaagatatctcaacaccgatatctaggatttttaatagacaaaaggcataattttctctcttcctaatgtggtaaaacataaagtttgatttgactggtgagattgagtctagaaaaataaaggggaaaagacagctaatacttctaaagatgctaaattctaagtatctgcatgctctcatttcatcctcagtagaaatcagtgaaaaagaggtgagaaaatggacccagagatattaaggcagacgtccaacttatcagtccactgctaatcttatactggtggtcctaggtgttcttcccaaagtgacattcatgcattcattcattgactatttgtttattcatcaaatactgtattccaggctctgaagccacgtcctggagattaatggtgaaaaacacaaggcctagctttatggaaacttattggttcctgaccaattctccaagttttaggtaagtctgagttctaagtcaacctattgacttcccattctacattctgttatctgcctaatcagtgggtattcttttggttgtatggctgtgatcaactcaagtatgagtcattcaaaaggggaaaaacaaaatgaccaacctatcttttctctgacacaatcaaccaaattagcgtaggaaaaagttattaagtcacatccattccatcctgggaacagagcaaaaccactccttgtattatgctacattatttttcaacaaaattgtcctgtataattgtaaataattataaatgactcagtggcaaagtttccaccatttcctctcaaaggttagcccacgctccagtaatttttagcatcaagatggtttctctgatagtcagcctaaacagcccttgtcctgatttcatctaattaagctctgatctaccctgatctcattctatgcaattcctcttttgctgctgtatttatatccttcaaatatagctatatgcctatcataacaaattctctcccctctccaccatggctgacctaatcttaagctaaactcagcagacaaaactgcaaccccaccataacttctagccatctcagtatttcctaccctatgcagaaaacaccaactaatttcttgcagttctgaggtcagaccttccaggtctcttcctatacattgggcagtggggcaggtgtccagagaccacaaattgcatttcaatgacatcctgtcacctccactcttctacttctctagggtacagaagtacttcctcagtgatttttttctaaccacatgttttgagggtctggcagaacagatccaattcagaagaacatcttagaagattttgttgaatctatctgggtgcagaacttattccttcactctcacactcaacttttgttgaaaactagcagtgtcataccctagtgaatctgacatgttctctctcaaggaattcacagtctaatacaggagataaataggtccctctccccaatttaccccctgccaccctccttttctaaagaaaatacaattcctcatctcccattcactcttcactgaaattgggcctctgctcataatgttttaataaagccttttctgccaaagtcaaccagtaacctctgaattagcaaactcaatagtcttttttcaatattcatccaactaaaatgcaagaatattcagcactattgattgttggactgctttttcttgaaatcctctccctgtccttggtttccatgacaccactctcccacgtctcctcctacatttctgagtgccctttctttctctcctttacaccactttctccctttcctctcagcagacagcttctccttatagttgatttaaaaagataagcattgagaaaagaacttcctcttctttccaccgctgcatcaccaacctaccttgccttatctcctcttaatatgggtgaattatccttatccttaacaaagttcaactccgcacttctgctctgatcttcccaaggaccttgctgctgcaattatatttgtctatgctgtccatttcttttctataccatcaatttctcccttgctactgaattatttccattagcagtcagatatttaatatttgtgattttaaaatttccccttatgtttaatatacttttattgaatgtgtccctttaacatatatattgttttgtgtgcatgtatttttatagatacataataattgtacatactttgggggtacgtgatattgtgatacatgcaaataatacataatgatcaaatcagagtaattggaatatccatcacccaaacatttatcatttcttcatgttaagaatattccaaatcttctcttaaagctattttgaaatatacaataagttactgataactatagtcaccctactgtgctatcagacactggaacttattcctttcttttaaaaattaattttattaaccgacaaaaatcaccatatatttatcccaattgcctctctagctaacactcttatttttctatactccttttacaactaaactcatagaaagacttactaccttcacttcttcactgtccattcttttatgaaacaatccattcaggcttttgtctctgggttgccaatgactttcatgttgccaaaatcaatagtcaattctcagaatcaatgtctcatcaacatttgacacagctgagtactccctctttcttgaatcagtttcttcacttgcattgtgggataccactctcatttggtttttctcctacctcactggccacttctcctcagattattctttgggtttttcttcatctgccctatctttaaatatcggagtatcccagggctcaatacaaggacctctcctctttgctgcctacacttaaaaaaattaaaggtaactttattttatcaagatttaatttccttttaatgtccatggttttagctcctgccaaaattagaggctgcctcctcaactggtccaacttaggcttaaaaatattttttaccttgaaataatttaaaatgtatgatagagttgtaagaacagtacaaggaattcctgtgtagcctttatctagattcaccaactgattacattttgtcacatttgctttttcactccctctctctctagacatataaattaatatgcatgtatgtatttactcatctatttcagagagagtttcagacctcatgcccctttacctctaaatacttcagtttgtctttcctaaggagagaaattatcttatacaattacagtactattatcaaattcaggaatttttatattaataccattttataatatacttaacccattaatgttctcacctggtgtcaaagctttatcagagggtgactccaaaatttaaatatttaaccttgacctattttctcaattctagactcttctacctaatttcttagttaacattagcatgtagctgtccaatagacatgtcattacatttacaaagttaatgtgtataaaaccaagctacttctttcctacttcttcccgttacccataaaacttgtttctcctccagtctttctcgcctcagtaaatggtaccacccagttattcaggtcaaaacccaaggaagcatttagtccttgcctacccattccctaccacagccctgcccaattcacacttgatccatcagcaagtcctccaaaacaaatcctaaatctaacaactttttaccatctccatcactaaaatccaaatccgactcattaccatctcttgcttgaattattccaagtagcctcctaacaagttttcctgcttcctctctgccccctacagtctgtttcccatacagcagccacggtgatcatctatcaatccaaaactaatcataccactgttctgcttagaactctctaacagcttccttctgcaaatagaatacatttgtacacatttgaacttcttaccagagcctacaaggccctgtgtgattatatgcctggcttcctctcctttcatgcttcctttgcttaccacactccagttttaaagctttctttctgacccttgaatacatcatgtatttttccatttaagagctcttgtacttgatattcttctggctggaatgctcttctccccagatctttatatggctgcctctttcttatcatttaactcttggttcaaatatcttcatagtggtcttccctgaatgagctaaagtctcccctgcccctgctgctcctaccacacccacatttagtcattttatatgcctttgcattgctttattttcctttatagcacttaccagtaatggatataacatgtttgcgtatttgtgattattgtctacttctcccattcctgttagaatatcagctccatgagggaaaaggctattttgttcactgatatacccccagttcctaaaatagtacccgacacagaccatggctctagtaaatatttgttagatgaatgaatgaatggttcccctctttgcatttagctcacatatgtcccccagaatctggtccctgatcgtcttcttttcctccctacattactgtttctggaagatcccatccatcccaatggcttcaattactatcgacccaaataactttcaatttaattattgagtcatttttttctttgtgtacccaagaaccatagttacaactgtctactcgtcctttatatttggacgtcttacagatgcttcaaattccacatgtctaaaactagctcattattttgtttctttttgatataaagcatataaagtacctagtcaaatgctcagtgtctaagaggcactcaataaatgctagttcttataaatagcatttgtaactagtatcttttaactcaatccaatttggcaagaaaccttgcactcatctttgactctatctctttcctttgctgaatccactatctcagctttcaagtatttggatgcctgacaacccaatacccctaaaagtctcagcctctaatcctcactgcaataacccttactgcccttgcctggcatacattcattccattcaattagctattcaatgagtatcgagcatgtaaccctgctaagcactatgatcactatacttaagataggaggaaaaacaacacatggacactgcccaaaatttacaggggggaaatagacaagtaaacaggctgttacgattctagatagaggaaattaaagggtgttgtttatgggaggaagcttaatacagtctggggatatcaaccctaacacttcttagaagtgataaagcttaggtcaagtcttgagtgttgaataagagttagctaaacaaagaagaggaaggagcagtcatcattttgggaagaaggagcagaatgtgaaaaggcacagagatatgagagaatatgttgtagctggatgtgatggttaatactgagtgtcaacttgattggattgaaggatacaaagtattgatcctgggtgtgtctgtgtgggtgttgccaaaagaaattaacatttgagtcagtgggctggggaaggcagaaccacccttcatctggtgggcacaatctaatcagctgccagcaaatataaagcaggcagaaaaatgtgagaagcagagactggcctagcctcccagcctacatctttctgccatgctggatgcttcctgccctcgaacatcagactccaatttcttcagctttgggactcagactggctctccttgctcctcagcttgcagatggcctattgtgagaccttgtgatcatgtaagttaatacttaataagctcccctttatatatatgtgtgtgtgcatatatatatcctattagttctgtccctctagagaactctgacgaatacattggagaaatataagcagttgaatgtggccataacataaagtgcaggcttgtgtggagatggcagagataaacaggcgttctatttcaaggggcctgttcaccaaattaaggagtttggattttaacctgaacacaatagggaactttgaagggttttggtgagtaaagatttcatgatgagatttgcattttaaaagatgactctggttgcactgtggagaataaattcaggaggtagggagcatggtaaaactagaggtaggtaaacaaattgagagacttgcagtgagcaaacaagagagaagaagtttgagaaattttcagcatatataaaatggccaagacttgctcaattagatatagcaataaggagctgaaaaaactgggttcactgtgaattatttacctttatagaggcacacaggaggagaagcagattttatcagggtttggaggtagaagttaatgactttaacatatagagttttggagatacgtgtggggtataaaaatgaagatacctagaaagaagtggtataaatgggagtgaggtatgggatggagtgagagatttagaagtcttatttgctaaattaaatcatggaatgaattaaatcacccagaatgtacagtgttagaagagtagagaaacttgtgcagaacttcagagaatattaatacataaggggcaagtagaggaagaggaaccataaaaaaggaatagacaagagaaagcaaagaaaaaccaggggaagcatagtgtttctggagccaaaggaagataaaatttttagaagacaataatgttcaacaatgttaagtgctgatgagaagttgtactgagttgaatggtgcccctgcaaaattcatgtttacccagaacctttgaatgcaaccctgtttggagacagagcctttgcagatgtaattagttattatgaaatcatactggactaaggtaggacctaaatccaatgactggtgaccttacaagaaggccacatagacacagacacacagagacacaggggaaagggccatgtgaagatggaggcagaggttggagtgctatgtctacaagccaaggaatgcctagggttgctggtaaacaccagaagctaggaagaatcaaggaaggaccctcccttagagccttcagagagagcatggccctaccgacacttggatttcagacttccagtatcctgaactatgtaatctctgctattttaaggtacccagtctgtgtcactttgttgtgacatccctaggacactaatacagaggtgaagtaacacaggaaccaaaaggagttcattgcttttcaaaatagtttacctgtgaaaggaaaaaagagcacaatacctaaagatgactataggtctgggaaaggtgttttcaaaatgggagacttgagctggtttgtagacttaggggaaaaaactaggacaagagaagggtaacaggttgaaaatgcctgaaaaagggagagtggaaattaaaggagcaagatttctttaaaaagtggaggagaatgaggtccaggacacctgtgaaaaaattgggtatgtccaagtgaggaggtaaactcttttaagatatacccctttgggtttcagaaagataaggatagaaaaaagtcacgtagattcatctatacagggtcttaaatgctgggatgaagtatttagacttatttctgcaggcagttggagcttttttgagaaaggaaatgacatgagccaggctaagcacaatagagacctcataactcatgagatttacccaaagcacaattactgctgattgaaataaatacagagatgtactttaggaagattaatttggcagaagtgcagagaatgggttggagggcatccagacaagaggtaatgagtccctggcagtagcaggacgaaggaaaaggaaatagatgagatggatattagaaacactgcacagggagctcagaaaggacttggtgactgctgggaataaaagagggaatttaagtggattctactattgtgagcttgattgacaaggatgggaaagatgccatagactgaaatagagatattaggacactggagggggttggttgggtaagggttaatgtacaccttggaatggaagtctggagctcaggaagaagggaaagctgggaagagagatctggcagtctcctatatccaggagagaggtgaaacctttggaagtggataaattcataaaagatgaattggcagaggaaaaagttaaggcaaaggatagaatcacaaacttactttaggtacagaaaggagacatttcccccaagtatagaaaggcttcctagaggaggtagcaaatgtgaaacatcccagaaacagtggaaagaaaccttgactggtaagaagaagctgctggttctagtctagtctacctctgtcgctgtgtggccttaggaaagtcctttctcattctaatcctcaatcttctcacctataaaatgaggtcactgaatacggtgattacagaaacctcttttagctctagcagtacattttcctttgattgaagcttgactttggcctttgttttggcaagagaggtagataactttctagatcaagaaatagtatacaatggcaaagaggcacatttaagaaaagagaaatgaatgaattcagaactagtcattttcacaacttgagctatccaacctaatgatcattctgattgacaattattagggtactatgtgattgataataacacctggtctatgagttgtgtaatgaagtttttttgtttgtttgtttgttttgagacagagtctggctctgtcttccaggctggagtgcagtggcgtgagatctcggctcactgcaagctccgcctcccgggttcacgccattctcctgcgtctcagcctccgaagtagctgggactacaggcgcccaccaccatgcctggctaattttttttttgtatttttagtagagatggggtttcaccgtgttagccaggatggtcgcgatctcctgatctcgtgatccgcccgcctcggcctcccaaagtgctgggattacaggcgtgagtccccgcgcctggccggatgaagttttaaccagtattgtactgcctgctaaaatcagtactgaaggataagtactgccttccttttacttaggaaaaagaaaagagcagttaccaaatggctactctgtttcaggtactttcatatatttacctaaaaggtaatttacatgaaggcaagattttcttttaaatctgttttattaactgatatatcactaatacctaaaatagtgcttagcacatagttttcaatattgtttgaatgacttgaaaaatatatgtatatattttatatatacacatattttatatgtgtgtgtatataatgtcatttgatcattataacaaacttgcaaaagagacattagtgttcttatcatacggatgggaaaagaatgactaaaagaggttatataaacttactcaaagtcacacaacctgtaggggtcgtgccagagtcaaacacaacagatttataagctccatgtgggcagggaatgtgtctatgttattctccatggtatccccaacagctaactccgtatctagatggaagtagcatttaataaatatcttgtgaacagaaggaagcaggcaagcaaacacacacttgtgtgaacccatataccattcattttaccctgtaccaaccacatcattgcccaaattcaaaagaataattgaatctcaagaatccagcagtttgcctaccatgtttgttggcttaaatattctgtgatttttttattcattctcacttgtagactacgatggttctctttcagtctttttaagctttagagagagcctcaaggtcttctttttggagaatgctttataccaggggccagcaaacttagtctgtgaagggccaggtagtaaatattttaggttttgtagactatatagtgtctgttgcaactattcaactttgccattttggtgtcttttttttttttttttaaaaacagctatagacaacacatagatagatcagcatgcctgctccagttgcttttattccaataaaatgttaattggaaaactagttagcaggccagatttggccacagaccatagtttaccccacctctgttttatattattattttaatttttctctctcttgcctttccaggacttctctaacactgtgccaactgtaaacatcttcctatccctggtatattaatacatggtaggacaacttcagttttaacaagtttcaacagttgtaaccccttccatttaattatagatggcaggagtattatgacaacaacaaagacaggacagctagggaggctggcaggtggcctagacaaggctcaaagatatggcagttccttttcataatcttaatgctggtccaggatctagataccaggttcatataataaaaactagattttttgctttttgatcagtgtacccaaaattgatcagttatttaaaaacagtctttcaaatatccataatcataataaactgaatggaatgtcatatgccaatttaagtgaccacgagaaatataactatcaagaaaaccagttactcatagttcctacttccctacataaggatgtgtaaaaaaaaaaaactcctgagtccttcctatgtgtcatagagtgtactaggtgctgagaacgcaacaatgaacaagcagcccctgtcctcatggttctagtctaagggtcatttttttttcctctatagagccaaataaatattttaggctttttgtgtcacacagtctgccacaactcaattttgccattttagtatgaaagaagcatagatagtacataaatcaataggttccaataaaactttatttatggacacttacatttgagtttcatataatttcacatatcatgaaatacgattcttttttccaccaaccatttaaaatatatacatatatgtatgtatgtgtgtatatatatatcaaagagatatctataccccatatctattgcagcagtatccagctgagatataaaatcaatctaagtgttcaaaaacagatgaatggataaagaaaatgtggtatatatacacaatggagtgttattcagccataaaaagaatgaaatcctgtcatttgcagcaacatggaggacgttatgttaagtgaaataagccaggaacagaaagttgaacaccacatgttctcactcatatgtggaagctaaaaatattgatctcatagaagtaaagagtagaacagaggttactagagggtgagaaggtagggggaagggagggatatacagagatttgttaaataatacaaaatggcaaaattgagttgtggcagactgtgtgacacaaaaagcctaaaatatttatttggctctatagaggaaaaaaaatgacccttagactagaaccatgaggacaggggctgcttgttcattgttgcgttctcagcacctagtacactctatgacacataggaaggactcaggagtttttttttttacacatcctcatgtagggaagtaggaactatgagtaactggttttcttgatagttatatttttcgtggtcacttaaattggcatatgacattccattcagtttattatgattatggatatttgaaagactgtttttaaataactgatcaattttgggtacactgatcaaaaagcaaaaaatctagtttttattatatgaacctggtatctagatcctggaccagcattaagattaatgtattatatattttcaaataactagaagaaaggatattgaatgttcccaacataaagaaatgataaatgtttgagataatagatatgctaattactgtgatctgatcactatacattgcacattggaaaaccactatgtaccccataaatacgtactatgtatcagttaaaataaattaaaaaatggaagtgaaagaataacctggaggctgataaatgacattggtaaggaaatgagagtgataatccctgcttgtctgagcttcaaaaatgaagggaatcttacatgagggtggaggaatgatggttcggaagttgtctatggagagcatggctaaaccagaatatgtcaatatactgtacattcaattgtatcttgcctttttgtaagaaaaagtaatacagtaccctaagactttacccacatcatcaaaaattacttgtgttcattttctctgtctgtacatttttgtaatttcctccatacacaacctctttctttcatgcatatttcttaagggcattcctgattgcttatgagtttgttcccattacgaatgacataaatttctccatatagcttctaattgattactgtggtctattgttacctttaaatttgttactctttgacttctcctttgaactggttgtaacactttacgttttcctcattaatgagtgaaatacaatctttaacatgttcattttttgtctacgtaagaatcaaaattttgccttttaaaaattattttaatacttgtaatgaattgttactgtcctatactattgaattagatttcatagaattccatgtatatattttgcatctaaattcacaaattggatagaatattctttcttagagcagtctgtcaggttttggtatcagagtaatgctagcttcaaaaacaatgtgaataattctgcaacattttcaatactataacatacttatagaattaaacgtggctatttctagaaaatttgaaggaattcacagataaaaatatctgtcccttaaagccctaaagtatttttagatgtccctaaagtatttttggaagtttctctttgataattgttttcgaagtttctactgttacatgtccatttagttttcaacttctcaataatttctggcatttaatattttattagatatttttaagttctctgagattttcaaatatattaaggtacaattatagtagtgcgcctttaatttaaaaaatctttctttgttgttgtattccatttgtcatttaaattttattggtaattcatctttgttttcttgattaaatttgctaaaggcttatctatttaattcatccctctgaaaagaaacctagtccttggtttcatattatattgaattattagtcatttaatttcattcttcatttttaataataaaatatttaaggttatgaatttacttctgaatattctcaaagttttggtaagtcatgatctcatttttattattgtttgttagtctgctagtgtttctttgtgctaatattcacatataaatgtgatctaaaatattcaagtaattgaagactttaaaatttgtttttaaattgtaaacattgtacattatcatcagatatttctactcttaagcgtgtgtaggctgggcttggtggctcatgcctgtaatcccagcactttgggaggccaaggcgggcagatcacttgaggtcaggagttcaagaccagcctggccaacatggtgaagccctgtctctactaaaaatgcaaaaattatctgggtgtggtggtgcacgcctgtagtcccagctacttgggaggctgaggcaggagaattgcttgaacccaggaggcggaggttatagtgagccaagatcgtgccactgcactctagcctgggcaacaaagcaagactctatctcaaaaaaagagtttgcaaagcttttctttgtgacatacatatgatcatttaaaaatattatctcaatatttgaagagacaatatgcagtctataaacaattttcaaaatgtattaattggatctaatgaattgtttttcaaatcttctaagtactttattttggtctactttattgtcaattaaattatgttaaactctcccatacagaagtttctatcactttttgtatagctgacagttttttctttatatatttggatgccatgttttttgcaaaaaaaaaatggttcataaatataatatcttcaatacggtttgtatcatcaatcaatataaaatgaatatcttgggatcaacatggttgtgtggtcattgttcctgatttttttttcctaatagagaagtgacatgctcaaatacctatttggagaatggattgattaggaaaaagtgagactgaaagctgagaagccagtgggaaggctcttagaatagtccaggtgagaaatcatgagtggctggattaagacaaaggcaaccaagaggtctatgtagacttggaattaattgaattgggtgagagaggagttgagggtgacacctacatttctgatttagctgaccattatctagacagcaatataggaagaagagctgggttggcttttcagaattggccatgttctaaagttccttctgtttatattcatcccaaaaggactcaagcccagacctaaagctaagtgttggatctttgtcagctgattgtttactcaaaccaaagtctttctacctgtataaaacactaggctgaatattcacaaattttagggtaatcacacttcttttacgtgttaagagctctttcataaagttgacgaaaaatttggactgaacgagagggaattaatttcctataccgtgcccaaggtagtccacatgtgaaggttaagttttccacaagagggcagcatcacctaataaattatgtcattgtaagccttcaccaataggggctgagatggggaggctaaaagggtagaaaatacaggttccgggagccataggacctgccacaccatgaaaaccaaagggccctgctagtccaagcccataattatagccactcctaagtgactgatagtggcagatgttgctacagtatgaggaaagaggacatggaactcaccctggcgagatgagtgggtgaaacacctgaacactctcattcttgtgactggctcagaagacactctagatagtgttcacactccctctaagttgctggtgtctctgtacaaccagcatctcacaggggcctttatttcttattcagatcattgccacccctaatgattccttagcacatcattctctgcaggttaggctgcaaagcacaccaccattctgatgctctcccaatttaacaatgtttgtttattccaattatgcttcttttagaccctaaggaaacaaatgggaatgaaattcactgacaacccattatgtgacagtcattttacataaattatcttatttaatcatcacaataatgccattatataggaattattatttgtcatataagagacctaggaagttgcaaacatgggaatatctaactccaaaacaaaaacgcttccaaattcaccaaattacccctccaagaagccttatttaagacctaaatcttgaccaatccaagatttaatcagtgataatgtatctattatataaggcattacttaacatgtcacctcctatccatgtacatgggcaggtatggattaatcttaggtaccagcaggtaatagaagtcagtgggatcctacataacctcattcttcctaggtccaaagcctttctccttaaatattctctcttcaggataaatcatttggatatagaacatgaggataatggaataattaaagatggcttctgtgtttctgacttggttggctgagtacatacatagtggtcctggtcatagatagcgatcttgggagaagatgatgatgtgttaggtttggggcatgttgtgtttgcaatatctctgacacatttaagtataaatgtctaataggaagttggttatatggtctggagcataggagatatagaaaataaattgaagctatagggctgggtgagattttccagggtacattaagttaaaaatggtggaactatgggaaacaccaacatttaaggaatggtcagaggaagagcaggtagtaaagagcctggtttttaaaaaatggacagggatgtaggaaaataacaaggaaactgactatcttgaaagtaagaggtttggccgggcgcagtgccttatgcctgtaatcccagcactttgggaggctgcggcagggggatcacttgaggtccgaagttcgcaaccagcctggccaacatggtgaaactccgtctctactaaaaatacaaaaattagccaggcatggtggtacatgcctgtaatccagttactcagcaggctgaggcaggggaattgtttgaacctgggaggcggaggttgcagttagccgagatcatgccactgcactccagcctgggcgacagagcaaaactccatttcaaaaaaaaaaaaagtaagagctttttttttttttattaacacgtaacagttatacatattttgggggtacatgtatcattctgatacatacatataatgtgtaataatgaaattaggaaaattgggatatccatcacttcaaacatttatcttttctttatgttgagaacatatgaattcttctctactagctattttgaaatatacaatagattgttaactatagttaccctaccaaactattgaacactagatcttattcattctatctaactgtatttttatacccatcatcaacctctcttcaacctccccacttcccagcctctagcaaccaccagtctactctctatctccatgagatccctcttttcagcctttacatatgagtgagaacatgtaatatttgtctttctgggcctgccttattttacttaatgacctccagttacatctgcgttgctgtaaatgacaggatttcattctttttatggctgaatcgtattccattgtatatatattccccattttccttatccattcatctactgatggattaggttgattccatatcttgtttattgtgaatagtgctgcaataaacatgggggtgcagatatctcttttatatgatttcctttcttctgaatatgtacccagcaggggactgctaggtcatatgataattctattttcagttttttgctaaacctccatactgttttctatggtggctgtactatttcacactcctaccaacagtgtaccaggattccccattttcccacatccttaccagcatctgtttttttttttttaataaaaaccattttaactggagtgagataatatctcattgtggtttttaatttccctgaagattagtgatgttgagcattttttcatatgcctgttggccatttgtgtgtcttcttttaagaaatgtctattcaggtctttgcccatttttaagttggattttttttttttttttttttttttttttgctattgagttgctgtgtgagatttttggtattgagtttcataaaggaaggtgggggcaaaatctagagctataatgttaaatgccatatatgatgaatatgaaaaataacccattgactttgacaattaggcaataatttgtagcttttgacagagtagtttcagtggagttctgagggtcaaattctggctgcagagggtggaaagctaaatggcaggtggagaagtggagatagtgactatagactcttcctttgagactgagtatgaacaaaaggagaaagacggggcaggagccagagggagaagtgagattgtgggaagatgcaagatggaaaaacttaggtgtgtatatacgataaagaaaaaaaaaaacaatagaaagggagaaggctgagctccaataatacaaagcaaaggcgcagcagcaaaatgaaagaaaagccatgtggaaagttcaccaataggcagatgcttttggtggtagcagaatgactgtgcccaaatatgtccttcccttccttctgcttatgccactgcacttacctgcaatgtcttcctcttctgatggtttatttttcaaattatactcaccctttagcttaaattccacttcctctatgaagtcttaccctatcaataccttctgcagtgatctctttctctaacagcaatttttgtctgaacaatccatttgataatcacacacaaggctttattgccttctttaaaaatatactgctacttagtcacatgtgtatattttgtcccctgctagactgtgcaatcctcaaggaaagggtttctaagagtttgctacagcctccatggctgtagtaggggctctttaagtctccattgatatgtggttcaggaatgatagtgtattataaagaaggagattgaaaaacactggattaggtagccctttggtatataatgagtaatttagtcctctttatagcaaataaggaaacagtcttgcagaggactaataaatatatccaagattatgtgtctatgtggcagtgccaggatttgaaccaaaggctctttctcctgtgctattctgcttcagttgtctgcaaaattctattcaagtgaaacacctctttcctttataatattgatagagacatgactctattgagctttattaccaaccaagtttcagtggcctctgcaccttacggagaatctccctgtaccttacctcctgacaatcagcttgagaatccggaaggagcctttgatgagaatgagggcctcttggcgggagccatataatggagtgccattgatattcaccagctcatcaccagtcctcatcttctgggacaaagctgccttgcctccatcttcaatctgtgttgcagagaacaaaacagaaagcaggtagtgagatgactttctccccaaaattctacttgtttcttccaaccctggagccacaagtagtactggggaatggctccaggcagctcctgggagtagctcaggagctgatcacaggtcattatttactgaaggcaaagcttgggcaaacctttgaggaaggaggcaacatggaaataatgcaatccctgactggaggaatgagcagtccaactgggaagactagaacttctaaatacgaaactgatgcttggaatgaaccctactatgtggctaaagcagcagcgtggcctaccaaaacgtgcagacaaattagagccagaagagctaggctccatcaaaatgacctttggtaagctctttcctatctttgggcaggctttgaagtctgacaaacgtaagtttgaatcctggctctgctacttcctagctgtgtgacccttaggaagttacttaacatctgtgtctcaattccctcctacgtgacatgtagataacaagactagctacctcacagagttgttagtatagtatatatctgagaacagtaagtcctcaattaacatgagctctgattattataacaagggagttgactctgaagacctggaaagtggcttacagttcaacattctgtgagtagaatggcaaattcaaaagatacaagtaggtacaatgtagctgcttctttatctatgtctcttcaacatgtgcccagcacagtgcttctagtgtctgacacacagtgagcattcagagaaagctggaaatatgggtatttactgttccaacacagcctatagaatttccactaaccagggcaatctggggaagaagattgtcagactgaggggtattgaaagcaaaggcagaaataatagccactggggcaggcaaaagcaaagcaaagcaaagcagaatgtctctgggggtccttgcttatggctaattttatacattcatttttattacattccttttaccatgaaggtgatttccacctattagaacatcaattccatccatgataatccatgaaaggagtcatctcatccatccattaatcattccttaagtattgaatcacatttctattatgtacaggacaacatgctacatgctagagatataaaaatgaacaaggctcctaatttctagcctcaggggcagaaattagttgtctacagcttgtttatcaactaagacggtcaggtaaaaaaggctccaactcactgatataatcaggagttgtttttgtttgtttccagggaaagggaacgtaaggataattaaattgtatagtccttaggggatggcagattctaaatggggcaattaagggctggtattcactggaggtatttttacacttctactcttgttccaatctctctctcagtcttttataatgtctcctccatctatccccacaccatggaagttataatattgttgagctttaggttggccagctcatgtgcaaatttggcagatgagacctcctgagtgcagagaaaaaattaagttcaggattttttaaactccatcgaattaattgaacttctgagttaaatcacagaatgttattacatttattgctgctaatccaacttttttttaaaaaaattaacctttgtctgacaaatcataggttagccaagtgacattgaatatatatgcctttgttccggtacccgggccacactcaacaccaaacaagccaatattggtaaatggggaacaactctaagcaaattaaacaggattacactcttatttccattgtcattatcattattacttcacagtcactgctgcctaccgccaagaaaaaaagagagagagaaaaggaaagtgctgtacttgaatttcagaagttctatttgaatgactcattactttggcatccatagaaggcccttagcaccagtcagaactttcaacagggatcagccatttgaaagagtttcccgaggctaacaaagaaccacaaacagaagtctaactaatgaatgctaatagattttccctgttgatgtacattagtcttaattcactctacccattgtttttaattcatacaacttaattatccatattactgttacccatagcaagtcttcccctcaatatgtattaagtaccatctttcgttaattaaacactctgttacagcagcaagatctctgtttattctagaccaaaagataaaaggggaaaaccttttaaactaaaatgcttaattattgctgtagcaaaagctcaggcatttggcattccttactgctccttcagctgccactatctgagtccttgcacagactccttcttggactacagcatcaggccaactgttcataccccttttttctgttccatgccccttctcagtcaccagcatcctcctccttaagagatatgttaagtgaaataatcctactttagtgcaagtctgaagatgctcagacaaaaagccagcaaattttgggtccccagcataatccaagagttcagaagggtccagatcaggaagtaagactccatttggttgaagatcccttcaactatatcccagactagcccttttccagacccagggtatttactgagctgtgcaatggactctatactcttccagacttgttggtcctttttaaattactgctcactggtctttctcctccccactctacctctagatttctgaggtctagcacgtcttctatttattgtctggcctccttacagccagttctataggtcaatgtctcagccacatatttgtttatatggaagacaaagcagatgttcatgtttctatcaataaaaaaaggaaaggaaggaaggaaggaaaaatgaatgagaggaagggtgaagggggatggaggggcgaaagatgatatgcatattcttccgtaaaaggttttgttttccccttcccaccttcctcctcctaactctggctggggccctggaaaggtgtgaatcaacaaacttgttgaaattaacataccttgtttgaggggctgtataacaatatatgatgctatccattcagtaagctttccagctcttcctgaatcagaccttcagggtggctttcttgtttcagttgaagtgttgtgaattctcagattagacccagatgcattggaatgtcggtataaacacacatcacaaagctcaatgtaaacgatggttaacttatgtgtcattttggattacccaagtgattgctgggctagcagtgagtggcccaagtaattgaaaattgattacatagaggtcatataaccaaaagccaggtggtgcctggaaagctaggaagagctgattgactttggacaagtccctttcccttcttgcagcctctcttctcttactggtaaaatgtgtaagagggactgaccagatgatctcctggggctctgacagctctgggccttttcagctctgacattcagtgacctgtgaacagttagcaaagtcatgcattatccttctgctgacacagataatctcagctttttgtcccattgtactctgccttcacccatgttttactccttcaaaattgactaattaacatccatctctcaattcccctggtctttatccactgtttcagagtggtccaccaaggttggaacacttaataaggcccagtcaggacactgagagaaagagattcctgaagccctattttgtgctaatgagctagcaatttggaaatttttgatgggtcttcaatgaagcatgaagtactctgatagctgtcaacaaagtgacaagttggccccttgagagtaaaggcaaacaacaattgacttaacagcacttgctggctttctagtagcttttatttagtcagatactaacagatacttgcttgggtctttgaatacatttaggagatgaaaaagggaatagaagaattattaaatcaggtttataatttaaaaatgcattcagaggagaaacaccatctgcagcaataactgacaggtactgaacacctattacaatagtgtaagagcagcattaaaaatcagtgacatgattgtgaatacctctgcctgctacaggaaatttattggaaaaaatgggcatcaactgaaactttcttggtcagttccaagagcttctggccaaattaccagcccatactgctacctccaccagcttgtctatcatctaaagaaggcaaacaacataattgtttaaattgatgtgtttgtttttttgtttttgttttattgtttttgcaaatagacagaaaagatccactcagaatactgtagtccagttatttaaagaaagaatataccttccgaatatctttttagcatcttagaaagattttcaagtttttactaacactccaggcatccgttcatcaatttggccttttctgggaaacgaatagaaaaatgtagagctagggttaagctggctttgggaagtttaactattaagaagtaggagcatcaaagaatgaataaagtgcttgctcattctgaaacttagtttgaaatcttaagcaaaccacaggttgggggctgtttctaatctaccctctttttccttgttggtatctcttagaatctgatcatgctaggagaaattaatcagggttccctggacatgggagatacaggctttcaaacctcggcagtcttcttgccatggctttcaatacctaacttgtctctttcagcaacttcttcccttaaaaaccgctctcaaatttccgaagcagtctagattagaaaaccaagaaactctgttcctaatttcatcttccgtactttacaccagttttccaaaaggcaaaacagacaacaaaaacttttcaatgagaattgaaaaacaataaccaattaaaaagatgtaagtagacctgattcaaaggagtaatccctatatgtggatagagggaagaggtgtacaccaagggagaagccattctttccctctaccagctaataagcagatgcccaaatcctacaaggagctgccccagagtataaagctctgtgaatcaggcccaagggctcccctgaccttgagccaacggaactatgcgctgtgccccacagcatgacctagcccaacagacagcttcttcctccccagctgcttaatcaccatctagtttactaatcctcacaacaaaggccgtctaagctccaaatcattaaatttccctggggattagctccagtcaaattctaagcatctttgccaaaactcagcccagtgccaccagctctaggaatttggtggtgaggacaggggaagaagactcaagagcactgtcccctatgtcagcaaccaaaggcaaatttgtctttgctcctgccaagtcagatcgtcctgctgtctctataagtctggtaaggggagacaaacgtgacggcacaagagtaaactgagggtttcttacattgctagcagatatgctcactggggctctgtcacctctagccatttgtttacactgaagtgttcttctgacattaatgctatcagtgtttgtggcaaatgttagtctttggtggtatagaacaatagtgttcagaatggggtacatatatcccaggctgtgtacaaggtgatccactggaacttctgtttatatatctacaaaaatttaaaaatcaagctttattaatatttaatattggtgataataaattagatcatccataaataaaattgtgtatactggggacacatactcaaaacatttttactgatgtacatttttactaaaaatgttagctggattacagacccaatgagaggactaaaatcataaggcttttagagaaaaacatggagcatatctttgtgaccttgaggtgggcaaaaattttttaagcaggatgcaaaaggtagtaatcataaaggaaagagtgatacattggagttcatcaaaataaaaaaaatcttcagctctaaaaaagggaaaagacaagccacagactgggaaaatattcataatacatattacctgacaaatgacttatatccagaatattaaaagaactacaaatcaataagaaaaaggcaaatagccaattaacaattggcaaggcttgaacaagcacttcactaaaagagatagccaaatacccaataagcatctgaaaaggtgctcaatataattcttcattagggaaatgtgatttaaaattatagtaaagtgtcactacatatccaccagaatggccagaattaaaaagacttaagtattggtgagaatgtacagcaatttgatctctctacgttgctggcaggagtataaagctgtacaaccattttggaaatctgtatgcctactctcagatccagcaattccatacttagagactccgaagagaaataagtgcacgtgtccataaaaagatttgattgttcacagcagctttattaataatagaaagtaggaacaacccaaatgtccttcaaaacatacacatacaaaaaatgacatgctatacagcagtcaaaaaaaagcaatatatgtaataaaatgaatgtctaaaagattatgttgcatgaaagagaccagacaaaaacaacacatactgtatgatttcattttatatgaaggtaaagaagagaggtgataatttgaaaaaatggttaactctgtactactgattgtaaaggcagatgagcataatttttggggggtgctagaaatgttctacatagttatctggctgcagatcatatgggaatatacataactaaacattcattaagatttgtgcattttactatatgtaaattattccttaatttaagaaagaattaaaagaataattagatcagattctaagagataccaacaaggaaaaagagggtagattatgggggcagtttccccaatgctgttcttgtgatagtgagggaattctcacgagacctgatggtttattctttattctttagtctttaattctagactattcagcttatatttctgaggtaggcaccaagactccagcatcattttcacatactcatagttttaatcaaggcaaaacatttctcttaaaacgttagccttcacaatagggctataatctattaatctacccactgttcctgtctgctttgagatagtattcatcctccctacctcttagaaggtagaggatttcagtaaaaaatgaaaataaagaacaacactttattttaccagttgacaggtaaaggtgaaaagtcttaatgatttgattccatttttaatctccagccaatttttgtcttgacatattataaaaatagaatcaattcctcatccaatgttggagccatctactgctactcctcttgtcaatatcagatatgtttctttcttatggtccccagagttcatgtcaatctcagatatgtttctttcttacggtccccagagttcgtgacacctactcctagaagctgaacttcatcaggctgttgtcacacaggcaactagcctttcctcaggcaccattactgtccctgatatggttaggctctgtgttcccacccaaatctcatgttgaattgtaatccccacatgtggagggagtgacctggtgggaggtgattggattatgggggcagtttccccaatgctgttcttgtgatagtgagggaattctcatgagagctgatggttttaagtgtggcacttcttcacgctctctctcacctgatgccatgtaagacgtgccttgcttccacttcaccttctgccatgattgtaagtttcctgaggcctccccagccagccatgtggaactgtgagtcaattaaaccttttttgtttatacattacccagtctcaggtagtatctttatagcagtgtgagaatggactaatgcagtctctttgttagattgcctatgtttcttgactgtctaataagatatgactttcagtgatacaaatgatcagagaaccttgcaaagctgatgtggtggagagagttcagggagaaccagagtggaacaaaccggaggaatgaatatggtagagtgcaagtgaatttgctcctgatttccagaagcagttgtcagcaacagagtttacccttgtatagcattaaaatagtctaggacaaaccagaaagtccataatgtcctccagcattaagagagcactgtgtacaaatctagcaggtgagccttaggaggctgaaaagaccaacagtcttttacctaccgcctaatataaaaacactataaagaggacatatcaattcattgtcattttcaaactgtgcattaatacttgtaagaaatggccaaattaaaacaagaggtgtgttaaattccaccagactgttagagagtgatgggaataattctacttggattaatataatctttatttcttcagtaacaagccattgttgatgtgaaaactatttttcaagttgatcaaaaatgcctttttaacttgcctactgaatgtgagtgagttggatacagtcttccagcccaagaggatgtgattaactatctggaatctgaaccatcccaaagccaggttcactcaataactcactgctggttctctaaagccatttatttataatccattatgcaaaaagccaaagacagtttctaaagagtacacatagccaacattagtcatttctgactggaaaaggacccagggactaaacacccttcggggtagggacaaaaggctgcctctggaaactactaggcctgctttgctgcctgaaaaccacttgtccagcttactaggagcctgtataccctccagcagatgtggacgaagggagagggggtttgttttctatttcccggaggtgggcacctgcatgccactcccagaacattatttgaccctgcccaggccccctttccttggcagtaattttaatctctggtctccacttagacctctgaccagtgggaggtggaggaggagaaaagagatttaacttcctcttacccttatgaataactgctaccaaagcaaacagctcccaaataaataacctaccaaggcatacatgtatgttgcaaaagcaataataataacatcctttactgagcctaggacagatcccattttatattaaatcagcacacttgctgctgctttcacatagtgctacaaatctgggaataagtgagccatcacacagtctgttccaagctactgtcctgttcacatcatgactgagaaatgacacaccatctctttcctactcaacaaaacgtgccaaataacataaaacaaaactgagtttccacaactgaaaaaaaagaaaaaaaatgcactcaattgcttatgtgttagtggcgggaagggactcttgcatcagagattatttccttttgcaatgacaggattaagttgagaagaaaatgcaggaggaagtgataggcatttgagttcaagacctggaaaataaataaggcaagcaatgtgaacgccattctctctgacatcagacctgctttttaagttaaggctggataaaaagagaggaccagatttttagcttcagttcctgctcattctcactcttctaactttaaacaagagtacagtcctgtcccttctcctataaaggttgaccccctctgatagcagactccacaaccttggcactgacggtgttcctcacagccgaggtcactctggtgcttttcctcctccctcaaactttttccaaccctccctacacattatcttttccactcccacctctccctgccctgccaacaaggcatttgagctcgccttttctacttcatcttccccttctgcccccctactccacacccagaccctctccttgggtttcctatgggcaaacttcaagccctcctgtcattaacatctggtactaacattcattaattaaatcagacagaccaaagaatgatttttacaatgtaaacagcagcagatcagaagctctacatgatctggccatgcatgcctttttgaccttatttcccacaacctctcatcctctacacacacacacacacacacacacacacacacacacacacacacacacgtcataccaaactttctgttcttcagagaggtcaagcccatccctatctcaagatctttgtacttactattctatctgttgagaacattcttcttctagatcctacatacctccttttatcattcaggtgtcagctcagatcttgcctcctcagagaggcctttcctgaccaaccacataaagaatgttccttctcttctctacccacatctcatcactctctatcacattacctgtcttattgtcttcatagaatttaccaccatcttacatgatctcacttatttctatgtatgtttacttgctgtcaagatacattatagtgtgggagatagtcaatgcctttatacagctctgtcactggcacctaggaaaataaatgtctgtattgaacacattgtagttgctcaacaaatatttgttgaaattagaattaaaagggatctcaggatatcaccctattcatttgactgattctggagaagtaacaatattttcactttgtttttcatataactgaggttcagggatattatatgacttgcccgggatagagcatctattaggtttaagatactttcttctgcaaggttgtgacaaaaccttttggatttcacgggtatattgctattcatgatccttaactagcaatactaagagttcttgctaaagagacactttaaactttgtaaaaagcattattattggctcagaataatccagaataattatcctttgagctaaatatcccatttgtcacgaggtgccccagggtgaatgttagactctcaatttagtggaaggaatggagcctttaaggaaactgaggtgtatggcaataataacttgtatccagatatgattctcctcagtttttaacattctctgccttaggaagttaatttaaaacacacacaagccctcacaaacagaccatgaacagtgggatatttaactactcccaccatctgggaattcaaagtaacatcgactccaccttcgtgtgtacagacattacaacaggctctttcagttcaccatccctgaaaaatttaagagcaaatccagatgatgggcataaaccagattctaatttgatttagtgcttcgttaaccagtgccctcagacccccaaaaagtatgtgtggggtggggggaaccctcatcaatgtccaaatgagtttgccctgacccaatttcatgcaactatagttctttccttaaaaaccatttgttcagtgggtttagtattttatacctctgtgagttagtgattataccttttgtgaggcttttcatataaacaaattcacaagtcagaaaataaatcctttgtcaagccaggttttctgattgggatttagaaaatatggccaccatgatatggctttaaaaagtttaatatctgtagcatgcattcagtgctaatggacaataagtgatagtgaagttttgtcaggtctgattcagattacctgtggctgctgtgagttatatggaattacacagagtttaatggttctctggcaatttgccttggctcagggccaaggcagctaacgcttcaatcaaactgctctccccacccccaccccaagacaatttcagtttctaagtcttgagtgtatctgtgatgaagccttcagtgacactctcatacaaatgccaaaggttttttttttctccgtctctttttcttccttcttctttatggctgcatatattaagtgctcctgtagctctgctgagacaaactgcctggctggtgcttataaagagaagagcttttaaggtttgattaaaacagaggagccaacagtcagaagatgagaacaggacaatatcccttttctctgcagtgccatcagatatatccaattcaccctaacatgggccctggacccaccctgcaggccaacttaaggcagcagccctcccaaatcacttgagtaatcaaagaacatatcccatcaaaggcaggtagcctgcctgacagaagaatcccatgcatggcaagttaccctcctctcttttaggaacccaactggccctgaagctgggattctgccacagattcctggcatcactttagcatagttgagacagtggacaaaggccaagtgaacaaaggccagaaacgtcctctacaaacttgcaaaaaaggcatgtacaactctgaggtacaaccgttctgtggatagcaaatattctgggtccaaactctttcatcaatcgctgttcaaccctgtcccctcaacctctcctaaaacctccagtggtgcttcagcactagcacctcctgctatttagctaaagtgactcctagaccctttgtccaactgattccaatgtcacatttactggctattctagagagaatgctcattttaagagactagctgccatagaagcagcaggagggaagggcagaaaccacaggattcctactttgcgctgattgccactaactcatttcagctgctaaggggaggccctgttgggggagccaggagaggaaatgggttccatgtacggtccactttaaattgttcacaattgcgtgctcaaaaatagtctctactaaacatttagcacgcccattagcacaagccataaagctttaggctttgctgtactgttcgcccaggctgcctaagctgctttcctatggcaaaatgatgaaatggttggcaagtcagatacatgcgggaaggataaaggagctccaaggatggttaaacctggacccaggaagaatggtttaatatgacttctaagcacataaaaaaaatttagagggaaggaccagctgttctcaattttgattgaaagcagagcaaaggaaaagaaactgacattgcaacgagaaggactgatataagcaaggaggaagaacttcctgccaggcaaaataggtaaatgttagactgagtggtcagtcaatgaaggttgtggaatttccttctttagagtggctcttctctgctatttctgtgtggtccttccagaggggtgggggacggaggaaagagaggcagccagaggtccaatttagtccctttcagcactcagaatctcttatttgcaacattccgggatctgtaacacggtcactgggacacttgaaaagaaagaagcaacgagaagcttgctggtgatcttaaacatttagattctccccaactttctatccctcacaatgagccaagcttttgccctggcccccacaatcccaagaaagcaagcgaagacttgcttttggctccacagggcccctaggccatgcatatgggaacaatattttctgaacccaaaagcagaacatggtctgacaattatatttatgaggacaaaaggatagaatatatgaaatcagagctgtcccaggaaatctgggtgtatggtctccatagccacatattatctcttctgagggtcccaacacagaagggagttaattaaaactatgccatgtggttgggggcctagattctttccctgtatgcagcaagatcagttaggactgtgaaaagatagggtcataataagtccagtacaaactgaaattcctgctgtgcaggttggagaaaaggagtagtctatgtgtctttcctagaatctcttcactctaaaatgcagctggagctaaggggcatgcctgtcctcactgaatcataaataatgccatatttatagaggggaagaaatgtgtctggcacaagggatcctatttatacattcattcattcagtactcagagcagtggttctcaaagtgtggtacctggaccagtagcatcagcatctcctgggagcttgttagaaattcaggactcaccctaggtcaaatgaatcacagactctgtgggtgaggccagtaatctgtgttttaatccctccaggtgatgctgacgaatgctacagtgtaaaaatctctgaattagaagtcctcctggtgatgctcacattgccaaccagcaacaataatattaaccaaaagaatcaaagtcacaggcatgtttggtaggggcaggcactagcccatcagtatctctgctaatttagcctataataactctcacagatttctcaaacaacttaaaactaccattcgacccagaaatcctactactgagtatccaaaagaaaataaattgatctaccaaaaagacacacttgtatgttcattgcagcactattcacaatagctacgacatggaaaccacctaagtgtccatcagtggtgggtcagataaagaaaaggtgatacatatataccatggaatactacgcagccacaaaaagaatgagatcatgtcctttgtagcaacatggatgcagctggaagtcattatcctaagcaaattaatgcaggaacagaaaaccaaataccacatattctcacttataagtgggagctaaacaataggtactcatggacataaaaatggcagtaataaacactggggactaccagaggggagagggagagggacgagggttgaaaaactaactattgggtactatgcttagtacctaggtgacgggatcaattgtaccctgaacgtcagcatcacgaaatacacccacgtaacaaacctgcacatgtacctcctgaatctaaaaagttgaaattatttttaaaaatgtatacacatataaaaaataaataaaaaatatctcacaattcctgggtcatggaatagtctgaatcttactacacacccaattccttgaagcctgggtttcaaaggtaactcagcctgtctgctttgataagattctttcaaataagccaaagtccctttgggtttttcatctaaatcctactcaggcacacacactcctctgagtattctgtgactgttttcgcccttagccttgatctaagtctcaaggaactgactagagctcactctaggaccaagccaggaacattttatgtttaccagccttatttttaattttaaacaaacacagatgaaagagtccctgctgtaaagaaccaccacttaatgctagcccttataccttagtaacattaaattaaaataaattacaacaaatagtcattgtttcacctcagtttaaaccgacaaagttaactgctgcaatcaatgggcaacctttcacaaacatttgctgaaaaggaaaagaaatgcttccaggtgaaacttatcaaagtgaagtgcactgaggaccaaatcttattgtatgccacctggttttctcccaaagcatcagtcaaggaaagaaaagagatctcaacacagcctcccagttagaatcaatgacttctaaccaccaacagagattctggttcaggtaaggaagttacacagcatggttaaaaccaacacacatgaggggaatttctggggtgatggtagtgttctatacattaatagagattttggatacacaagtgcatgggatgtcaaaactcacccacgtcagattttgtatttcattgtctgtaaattttacctcaaaaggaaaagaacacctgtaaacaaacattgaactctagtaaataatacacgtgctgaaattttagggggacctgcactgatgtcctcaatttacttggaaatgtatcagaaaataatattgatgagtgaatagagaaaatcaatacatgaatagatatgaaacaagtatagcaggaatagattagtagaatctaggtgatgggtatatataagtgtttaatgtaaaattcagcttttctgtaaatttaaaacattctgttataaaacgtcagaaacacacaaaaacaagtaaaaaatttggatttttattgtcccacagacctttcattgatgtatgcattccaatatgcatgaactgaaatcgtactatgtgcaaggcactagatcaaatcctggttctgccatttagtgacagtgtgaccttgggcaagtcacttcacctctctgaaacctgtttccttatttgtttaatggtgagaataataacacctacctcccagggtggttattgttgaaattacacttcaattgctgaccacctaatgagagctatattgagtagggaactctcaattaagtgctacttgttcctctcccctgtgggatctgtaggggatctcaactatggaaattcttttgtgtcagcttcagcttgattgctgagcactttttgtttcttgaaaattgcagcctgggccacgaccttatattatggtgggtatatagtgttcatatgtttcaactgactccctgacattcaattgagttttggttttcaaactcccctttgcaaacaagaaaaattagaaagattacccttcacagcctctggtaaccatccttctacaacacggagactatagtaaatagtaatttcattgtaaatgttaaaataactaaaagagtgtaactggattatttgtaactcaaaggataaatgcttgaaaggatagctaccccattctccatgatgtgattatttcacattgcatgcctgtatcaaaacatctcatgtaacacataaacacctattacgtaccccaaaattaattaaaaatagaaactttctgaaaggagtataaagcaaaatttaagcaagagattaaagctggagtgtggtctaaggtagttctgcctacatccatttgaacccatggtgaaaacacttgactcactctcttgcttaccttctctcatagttctgacatcttttccagctctgggatgactccccacaaaacagaatcctgtcatttggaaaacatgctcaacccttgttggtttccttttcagttcacttcctgagaggattctctcagcactcttccccttgatgcgtatcccatcattcactaattggtatgagagaggtgaaacagtctgcttttcaagggtaggtgtatgctcctctgcaaggggttgcgtctggcttctctgagtcccctacctggtttgaggtaacaggaaggttgactgttctgccaggaaagcactgccaaactctgggtctggggaagcaactcgagagcaggcaggcgggtatccaccccaggagataataaagcacagcagaaaagaaacctgggcctgagaagctgtccgggagggttctttacgagcctgtttaacagcagagctctatgtagcacaggaaatcatgcacccaaagtgcagcagactttatagtggtcagacctaatcaggctataattaaggcattttaggaggcaaaaagtctttggcagcaatgatgtctacacaagagagtgatgtcaagcaattatttgtcactgggactcaacatctagcccaaagattcggggcaggcacagtagctcatgcctgtaatcacagcactttgggaggcctaggtggggggattgcttgagcccaggaatttgagaccagcctgggcaacatagggaggccctgtctctaaaattttttttttaattagctgggcatggtgtcatgtgcctatggtcccagctactcaggaggctgaggtgggaggattgcttgaacctacctaggaggttgaagctgcagtaagccatgattgcaccactgtactcccacctgggtgacttgtctcaaaaaacaaaagtaaaaataaatttaaaaataaccctaaggttcaccctgtcctcacagtgccacccacagtactgatgggactgattaaactagcacttgaaaaaatgaaaagattgctttattttcttccattcaacgtgttgtctcttcactgtttattgcttcctttgttgtgcagaagcttttaaatttagcatggtcccatttgtctattgttgtttttgttgcctgtacttttgaggtctcagccataaaatctttgcccagaccaatgtcctgaagagttttccctaggtttttctccagttattttatagtttcaggtcttatgtttaaatctttaattcatcttgatttgatttttttatatggtgagagatacaaaaatcatttcattcttctgcatatgcttattgagttttcccagcaccatttattgaaaagggtgtcctttccccactgtatgctgttggtgcctttgtcaaaaatctgttggctttatttatttatttacatggctttatttctgggttctctattcttttccattggcctatgtgtctgttttcataccgacagcatgctgttttgtaatatagccttgtaatatattttgaagtcagaaggtgatgcgtgcagctttgctctttttgctaagcattgttttagctatttgggctcttttttgctttcatacaaactttaggattattttttccaattctgtgaaaaatatttgcaaactattcatccaacaatggacaatatattgtatatttcaaagtatctagaagaaagtatcttgagatgttaccaacacagaaataataaatacttaaggtatggataccccaaatacactgacttgaacattacacattatatgcatgtaacaaatattcacatgtacctcttaaatatgtagaatattatgtatcaataaaagaaaaaaaggaaaaaactggacaatggggtgggagattcctttatatttaaataatatttactgtttttaaaatgcacttcaacacttttaaattataactttaatttacagtatgttaagatagcaacacagtataggagagtgcaacttttaatgataggatatgtgaaactctgtagtcaaataatccttcctgaaaaagttgatacacctgcccaaccagttattagaggctcaatcttctgcaattcccagaggatatgctacagaagatcatgaagcttcagagaatactgttctgccaatgaaggtccatgttcagagacattttgagaccctgttacatagagaggcttagttttcagactgttgattagaagctctagggaacatgtgccagttaaccacaacagatggagaggagggagaaaaaagttcattacactgttgtttactcattgttttctatagactctaccccttagtgtgtccctaaaatacaaaataagaaggctgtttgagggctttgcttatatatgtttctatgttatacagattttttcatatccctcttattgcttgatacgctcctgacattctgcctaccccttccctgtgaagcctggttaggttagtaaggcctgtgcactcccagagcactctgcacacacctctactcttgtgttcacttaccaagttgtactgaagttgtctgttcataagtctgtgtcccctgctctactgggcagggggtctctctcatacctgtgtccccagcacctatgggtgctcagtagatgtgtgttgcactgtttggggaaacttaaggttagtacctaggttttattttaaactttcaatctaacagtgccttttacacagtaggtgttatgtctgatgatagtaatttttaaaaggcctcagaaaacaaataacctgattaaaaaatgggcaaaagatctgccaaaacattcctcaaaagaagacatggcaaatggccagcaggcatataaaaatatgctcaacatcaccaatcatcagggaaatacaaatcaaaatcacaacgagatatcacttcatgcctgttaggatggctactatcaaaaaaacaagagtgaagtgttggtgaggctgtggaggaaaggtggtggttaggtgctgtggtgaggcttgcacagcggtggtgggaatgtaaattagtacagccattatgaaaaacggtatcaaggttcctcaaaaaattaaaataaaactaccctatcatccagtcatcctacttctgggtatatattccaaaaaaaaaaaaaaggaaatcagtatcttgaagagatatctgcacaaccatgttcatggtagcattattcacaatagccaagatactaaatgtccattaatggatgaatggataaagaaaatgtggtagatatatacaatgaaacactatgcaaccttaaaaatgaaggaaatcccatcatttgtggcaacatagatgaacctggaggacattacgttaggtgaaataagccaggcacagaaagacaaatactgcctgatttcactcatgtgagagcttattagaactattagaatcaaagggtagaatggtgtttgccaggggtgggggcagataagtagggggaagggggtttggggaagatattggtcaaaggatacaaaatttcagttagacaggaggaataagttcaagagatgtacaacatagtgactatagttagaacaatgtatcatattcttgaaaatcacagagattttaagtgttctcaccacaaaaatgacaggtatgtgaggtaatgtatattttaattcgctcaatttagccattccacagtgtttacatatttcaatacatcctgttgtacaccataaatatatataatttttatgtcaattaaaaataatttttttacaaaggtttcaaaggtatatggcaccttatgtgacttaccaaatgtcttcacattatttcacatgacccctaccagcagcctgtttagaagcaagtcaaatattttaacaactgccatttgacacataagggaattggcttggagcaattaactgagtgtccaaggccacacagctaatatgaactcagtggatactttgaatctaccctattgttttccagtgcccatgtttctctcctttttataaagatagaactgagaaactttgacacctatatggtttcccagacttacttgttaggttcctctcacttcaactggagaacaaagtaatgatttaccttgatacccgctgacagtcattatgaacagctgaatcaaccaatcttaaagcctgcctcttccctagaattcttgttatgtgagataatacatttcctaattgtttaagccagttagagtttgggtttcagttacttgcagcctaagtcgtacctgacgtacgatgcctgcttcccaggaagactaaatttcttaaagatagggctccagtcattctcccagtctggccttctctacagcacttccaggctggctcactacaagggactattcttgtaggggtaagggggatccatctcagagaaagggtgccagaggatttcctgaaatgaaagttaacttgttgctgaagggaccaccagttgtaaagccatggtttttttgtttgtttgtttgagacagagtcttgctccatcaccaggctgcagtgcattggtgcgatctcagctcactgcaagctccgcctcccgggttcaagcgattctcctacctcagcctccccagtagctgggactacaggcgaccgccaccacacccagctaaatttttgtatttttagtagagacggggttttaccatgttggccaggatggtctcgatctatctcttgacctcgtgatctgcccacctcggcatcccaaagtgctgggattacaggggtgaaccaccatacctggcttgaagccatgttaattggttgcagcagaagccaagcaaccaaatcagaagagatttaatgtattctccacctcaaccccacacaccagtgtctctcttggcagtgctgggacagaagggacaagaacatttacatcacttccaccagatagtccttcagcccacttaaaaagactccaagccagcatctccccagaaggcagcagtcttcaattactcacattagggcagcagttttcaccccaaatctcaaaaggctttccagcactgtgggtaaggaaaatttccagagagatgactttatgtctcagttccattaaacattcattgtgtggctgagatgtactcttggaatacttccatttccccagtaatagaatggaaataatacttgctctttccctcccttccaaggacactggaaatgtgaataacattcatgaggtctgcaagaagaccaagaaagtgccctgcaccaggttcaggcctagatcctgaaggtttttagaggattacaaacagaatggctccatctaccaacatcctctatgataagcaacaaacatatactgagtgtccactgtgtgctgggtccagagcttggctttggggctacattggtgaggaagccacttgtccctactctcaaagggttcccagtattgtggtagagacaggcatataaatccagatgcggaatatgataatttcaatttgctgatatctgtgtggaaaagttgtgagagataagctggaaacatgcactgggatgagatgaatcatgaatgcaaaagtaatcctaaacatatataaaaaccaatatagcagcagcagcaccaacaaagcagaatagatgcaggtcagtgcatggaacaatgtcctccaggtcccttgctgtgctgggcactaaccctttagtggctgggtccaagagttgggaggggcagctggggcagcaggaggggtcttgaagaggctcaaagagcctctcaaaggatcccataattttaacaagaagtgtggtcatatcagtgaatactagttaaatacagccctgcttctatgtcatgtgaatgagcatgagtgctaccttgtggtcatccaggagccccaaaatgtcattgggttggaaacacactttagcagcagtgtggaagatgggctagattggggcaccatgaagtcaggcagataagtaggaaggctttgtaatataccaaggaagatggatgatgtcctgaattactgaagtggcaggcccaaagatgattacataaatctccatttctatagatctccttggttcctaagaattctcccgtctttttattctcttggctacaatctcctagcccaatgcaaacttacacacacacatgcatgcttgtgtgcagatcctgcttcagtatgtatactcaactagtggctggcaggctgtaattatggcaggcaagaggcctgccaagaaaaattcattcaaatactgaggtcatcctattcccagctgcaagagagtggctacagtataaactctgccttcataaacccaaactatatttttggatagtcttctctatttttccaagcacagtcacacaattatctcatttgttctcttaacaatagtcctaggaggtcagtaaggctgatattatttagctccaatgtagagacgggaaaagtccttcaaagagaaaggacttgcctaaggtcattcacaatgagtcagtagtgactctacgactaagatgccttctacttcttggtcccatgttcctctcaatcttttccatataacctccttcagatacaatttcaggtcatttttgtttccacctcctgcaaactaatattcattctatctattctaatagtcatttctaagagaattctgtggataaatcagagtcgccaattttatcctccaagtccttgctcaggtctcaccattccctccaggaaattttccctggtaactatagttcagtaacctcaaccccttcttctttaaatatttactctcagtattaatgtgttagtgctttatgctctcttgttgtgttcagattactccatctgtgacttgtccttttcttctccccgcctagcacaagatttggcacataagggaacacttactaaagtgttgttaatgtatggcttgatccattaaagcctaactctggcatcagactgcctgcaatttccagtcaacaacaaagcactctgaatatatgtgtttgtgtgtgtgcacacatgtgtgtgcgtgtgtgtctgtgcaccactcatctagtgaccctgagggtaactaactcaatgctgtcaaaatgcagcatcagcacatagttattttacattccagtaggaattgaagcaaggaaacttttctccctaattttttcaaaataaatattgctctggttccaaatggtatatttttgacatcttgtgtacatttctgaaatagagtccagatgagaaaccagctaatgtgtatgtccattccaatctgagaacagtagattcccactcataggcaattttgtttctgaaatctcaattgcagaaaaaagactagggggagcatgtttgcaggaaggggtaaggccgacatgaagtgactgctagacaatctgaggcttgggggcaagacaaggacatggggaagaaaagaaggggatgtgaaaatttcttccctctcctcttatgattgcccacacagatttttaagggacatgaatgggaaagcagctgatggctgctcccaacaaggcaggataattgcaaaatatcatttagacatgagggtggccaaaggcaggtgaaccccaagaagacaggtaaacaggccccagagaacaccatccacttggttgtctgctcagaaactcctccttagagtccccaactgagagtaaaggaatcatttttctatttcttctacaacatacaatattgcccaagtacctactatgtattaagtactgtgcttggcacttaccaatataaacctttttgccttgtagtgattcatactcccattttacagatgaagaaactgagagataaagtcttttactcaccatcccatagtgtgtctgactctatcatgtaggttctttccattgcacaactctgccttcccaaggtatgttcagtgagatctggcaacaagaagaaagctgaaaacccctccctagcaagcctaaggtttcacagaggcacttagtcttaaatgaagagtgggattataacctaatggagaaaaagatggaaagcgcattcattcctggctgaaggaatagcagatggaaaggcactgatgtggggaagaaaaaaaaaatgttcaagaaagtataaatagttttgtgggatcacctgagggtgaggacaggtgatagaatatgaagcgagagcaactaaggccagattataaagggtttcatttcatatgccatgttagggaatgtgggttttctcctggagatgagatagactggaagagagggagtactgatatcagatctctgatctctgttttgaaaagatcactgtggcactgactgcatgcagggacaccgagccaggaaagtctggcaataatcaaggcaagagtcaagatggtgaaccaagtgaggcctagctcagaaactactgactccagaacagttgttaccagaaaggggtctggattcagaccccaagagagggttcttggatcttgcacaagaaagaattcagagtgagtctgtaaagttaaagcaagtttattaaggaagtaaaggaataaggaatggctaatctgtaggcagagcagccctgagggctgctggttgcccatttttatggttatttcttgatgatatgctcaacaacgggtggattattcatgcctcccctttttagaccatacaggataatgtcctgatgttgccatggcatttgtaaactgtcatggtgctggatggagtgtaacagtgaggataaccagaggtcactctggtcgccatcttggttttggtgggttttagctggcttctttagtgcaacctgttgtatcagcaaggtctttaggacctgtatcttgtgccgacctcctgcctcatcctgtgactaagaatgccttaacctcctgggaatgcagcccagcaggtctcagcctcattttacccagcttctattcaagatggagttgctctggttcaaacacctctgacacagtcagtcactgcaaattagcctgaatctttaagctcaaagctaggattccaggctttgcagcatctacccccatagcccttaaatactgtatgtgttgctttggcctcaaaactagtaacaagtcttgctttgtcctctggggcctcctcatttgtctccattttctaagctggcagctttgtggctcccctgggcctagcctagcccagctggctgggggtggtggagagaagtcaggtaggatccaagcagaaagggccatgattagcacatgtttcacattccccacattgcatggcaattcccaaccaaatcctacaggattgttttcttaaagatttgggaggagtttggggcttcttctctttctttcttctttgttttattctgtttctggactgcagctatttcctctgtccttgagttaagtaatagcagagagggagttaaaatgaaagtttgcagcaatgcagaaaagatgtttctagagatgtccagaggaaggagggaaatctagtatgggggcccacagcaatgttctgggaaggccagggaatgtagctgctgggggtggggcttcagttacagcaaatgtatagaagttaggctaaaacctacctaagggaaggggtccctgactctcaggccagcttcagtccttgacttgtttgcatttagcactcagtagattttcctctggtcatcagtacctgctaaaccccagcgcagccctaaggtgtggactctccctttaaccaaggaaattaaagcattaaaatgaaccaaaagcatttaatgggtaaaggcagccagcaatacactcacgggaatcccacactcctaaataacaggagggtcttgcaaaagccttccaggcctgcttccttccgtccatccttcctttcatctctctctctctctctctctccatgaatttctgaaatagaacccagatgaaaaacctgttcatgtgtatgtctgtcccatctaagaacagtagattctgactcatgggcaatttcattccggaaatctcaattgcagaaaaaagattaggagagcaggttttattttattttctatcctccctttccatcatttcccttgagatagcatacatcaataagtagcatgtagggaagcactgattgtttcttaatttatagctttattgagatataatttacacacaataaaattaccataccataaaattcatccatttaagcgaaatgcaatgattgtttagtatatttaaagagttgtacaaccatcaccacaatctaattttagaacatttccattgtcctcaaaaagaaactgtaaaggtattaattaagaaatgatcagtgcttccgtacatgctacttattgacatatgtgatgtcaagggaaatgatggaaagggagggggatagaaaatgaaataaaacctgttctgctaatcttttttctgcaattggaatttcaggaatgaaattgcccatgagtcagaatctactattcttaaatgggacagacatacacatgagcaggtttctcatctgggctctatttcagaaatgtggtggggggagggggggagggagggggaggagggggagaggggcagggagggaaggaaggagggagggagggagggagcaagggagggagagagagagagagagagagagagagaaacagagggagaaacaaacaagcctgggaggtttttgcaagaccctcctgttctttaggagtgtgggcttcctatgagtgtactgatggctgcctttacccattaaatgcttttggttcattctgatgctttaatttccttggttagaggggagagtccacaccttgagggtatgctggggctacagcaggtgctgatgatcagagctttgagctcatatacagtcagtccatgttcctttcaggcctctgagcccatggtaactcttacagtggagggtaagtccgtccccttcttaatcaatacagaggctaccaactccacattatcttcttttcaagggcctgtatcccttccctccgtaactgttgtgggtattgacggccaggcttctaaacctcttaaaactccccagctctggtgccaaattggacaacattcttttatgcactcctttttagttatccccacctgcctagttcccttattaggtcgagacattttaactaaattatctgcttccctgcacagccacacctcattgccaccttttcccccagttcaaagcctccttcacatcctctccttgtatctccccaccttaatccacaagtgtaggacacctctactccctccttggtgatggatgatgcaccccttacgatcccattaaaacctaatcacccttaccccgctcaacgccaatatcccatcccacagcactaaagcctgttatcacttgcctgttacagcatggccttttaaagcctataaactctccttgaagacagaagaagagagccatgagccaaggaatatgggcaacctctagaagctaaaaaaggcaaggaagttctctccttgagcctccagaaaaaaatgagccctgctgacatgttggttttagcccagtgagactcatgtcatatttctaatgtacagaactgtaaaatgataaatttgtattttttaagctactaagtttgtggtaatttcctataacagcagtagaaaactaatataaattgtcctttcagtttctttctttctttctttttttctagacagagtttcgctcttgttgcccagctggagtgcaatggcacgatcttggctcactgcaacctccgcctcctgggttcaagtgattctcctgcttcagcctcccgagtagctgggatgacaggcatgcgccaccacacctggcttattttattttattttattttttgtatttttagtagagacggggtttctccacattggtcaggctggtctcgaactcctgacctcaggtgatccgcctgcctcagcctcccaaagggcgggggttacaggcatgagccaccgtgcccggccccctttcagtttctagacagtgtcttttaaagaacaaaagtttctaattttgattaagtccaatctttatccatcttttcatcacttatgtctttggtattgtatataagaaatcgttgctgatagaacttccagaatagggatatgaggagctcggtggatcctctcccatttaaagtctctggaaattgtcctaatggcttatggaaagtgaagaaatgtttattcaagtaaacttagtgaattttggtaagaacaataggagtcagtggcatttgatacatgacctgttcctaacccatctctatcccagttttatggatacaaggcagatgtggctaagaaaagaggaaggctccctttatccccagctcatagtcaagactaagacccaggctaaggttattctaggatttcaccccagaaggggaaatccactggcacctcttatcctcagtaggcccttgttatgaaaatgctgctctaggaagctgcagctaagtggactgggtctctttcccccacctcgctccactcataagccaagggctctgctctggcaaagcaggccaagaatactaaggccccaatcacctcaccacaacttgctcatagggcataggttccacggtgggaggcgcaagcagagagtatcagggccatatctccctctgatatggtttggctctgtgttcccacccaaatcccatctcaaattgtaatccccacgtgttaagggagggacctggtgggaggtaactggaccatgacggcagtctctcccatgctgttcttgtgatagtgagtgagttctcacaagagctgacagttttaaagtggggcacttccgctctctctttcctgctgctatgtaagatgtgccttgcttttccttcaccttctgccataattgtaagtttcctgaggcctacccagccatgtggaactgtgagtcaattaaacctttcttcttcataaattacccagtctcaggtagttctttatagcagtgtgaaaacagactaatatagaaaattggtattgggagtggggcactgctataaagataacctgaaaatgtggaagtgactttggaactgggtaacaggcagaggttggaacagtttggagggctcagaagagacaggaagatgtggggaagtttggaacttcctagagacttgttgaattgttttgaccaacatgctgattgatggtgttatggacaatgaagtccacgctgcggtggtctcagatagaatgaagaacttattgggaactggagcaaaggtcactcttgctatgctttagcgaagagactggtggcattgcccctgccctagaggtctgtggaactttgaacttaagagatgatttagtatatctggcagaagaaacttctgagcagcaaagtgttaaagaagtgacctggctttttctaaaagcgtacagtatatgcattcacaaaaagatgatttgaaattggaacttatgtttaaaagggaagtagagcataaaagtttggaaaatttgtagcctgagcatgcagtagaagagaaaaacccattttctggggagaaattcaagcctgctatagaaatttgcataagtaacgaggagccaaatgctaatcaccaagacaatggggaaaacatctccaaggcatttcaaagatcttcatggcagcccctcccatcacaagctggaggcctaggagggaaaaatggcttgggccgggcccaaggccccactgcattgtgcagcctcaggacatggtgccctgcatcccagccactccagctccagccatggctaaaagggaaaaacgtacagctcaggccattgcttcagagggtgcaagcctcaaaccttggtggcttatcacatgatgttgagcctgtgcacagcagataagagctgaggtttaggaacctctgcctagatttcagaggaggtatggaaatgcctggatgtccaggcagaattctgctgcagggcagaggcctaatggagaacctctactagggcagtttggaagggaaacgtgaggtcagagatcccacacagagtccccattggggcactgcctattggagctgtgagaagagggccaccatcatccagaccccagaatggtagatccactgacagcttgcactgtacaacctggaaaagccacaggcattcaatgccagcccatgaaagcagccatgggggctgtaccctacagagccacaggggtggagctgcccaaggccttcggagcccctcctgcatcactatgccctggatgtgagacatggagtcaaaggagattgttttggagctttaagatttaatgaatacccttctgggtttcagatttgcattgggcctatggcccctttgttttggccaatttctcttatttggaatgggaacatttacccaatgcccatacccccattgtatcttaagagtaactagcttgtttttgattttacaggctcataggcagagggaacttgcctggtctcagatgggactttggaattgggcttttgagttaatgctggaatgagttaagactttggggaattgttaggaaggcatgattggttttgaaatgtgaaaaggacatgagatttgggaggggctggggcagaatgatatggtttggctctgtgtcccacccaaatctcatcttgaattgtaatccccatgtgtcaagggagggacctggtgggaggtgactgaatcatggtggcagtttcccccatgcttttctcatgatagtgagtgagttctcacaagagctcatggttttaaagtgtagcacttcctcactttctctctctcttctgctgccacgtaagatgttccttgctttcccttcaccttctagatgattgtaagtttcctgaggcctccccagccatgggaaactgtgagtcaattcaaccttttttcttcataaattacacagtctcaggtagttctttatagcagtgtgaaaatgaatataccctataccaggacttgctcatataataggggtgtcaatctagaagaaacaggccgctcttgctacattcagctccagtgcaatgatccacagcttctgcccagagggagaggcaggtaataaaaacagaaggctttagcagttctgcctgaggggattgactttatttggaacagaatatggagaagtttatgtctgacaatgttattaaatcaatggagatcttggtgagcaatttcaagaaggctggtagctctgtgatactagtgaaatgcaaactgatcagaagtttaaaagacagagccatagaaatagcccaaatcccagcactttgggaggctgaggtgggcggttcacgaagtcaggagatggagaccatcctggctaacacggtgaaaccccgtctctactaaaaatacaaaaaattagccaggcatggtggcgggcacctgtagtcccagctactcaggaggctgaggcaggagaatggtgtaaacctgggaggtggagcttgcagtgagccgagattgcaccactgcactccagcctgggcaacagagcaagactccatctcaaaaaaagaaaaagaaaaaaaagaaatagccaagcagagccctcctggggtcaccaacatcactggacatctgaaagcctgtgtgcataagctaggctacacctaatcagaagcaatcagagttagaaggaaggcagacttgaaagtattctccaagccacacacagatccattagatcaaggggcttttgcacaactcctgatgaaacactggctgaacaataggctattctgacccaagggctgcttctaggaattcaggtctaaaaacaaagtaaaactaatccctagtggtctggtacattgtgtgcatgcccaaggctgcaccctcatagaaaagaccagagagagaacatctggctaaatgtaaaaaaaaatcataaacaccctcaactgtgaaaacaaactcaaagctacaaatacatgcaaaagtaaagagtctaactgactaaggggagtaatcataacctttggtgattaaatggttcatgtgcacccaagggtgacccctaagaagacaggataaaaaataagaacaaagaaaaaaaattggggaatggatattagaggctgcatacactactggaaatagactatcaagtcaaaaaataaacagacaaccaaacaaataacagcaagtcccaaaaattgggggtgggggtgggagatggtcattacttaaagctgctacacatatcattgatgtggaaaagagatcacatattattttaaatgtccagttttcaaaagaaattacaatatatgaaacaaagaggaaagcacagcccatacataggaagaaaagcaggcaaaagaaactgcttttgacagagtccaaatgttggacttacccaagactataaagcagctattataaatatgtttaaacaactgaaagaaagcatgcttgaagaatgaaagaaaagtatgataaaaattcatcaaatagagaatagaaaaagagacagaaattataaacaagatagcattctggagttgaaaatagaataatccaaatgaaatattcactagagatttaagttggcagaagaaagaatcaataaacttgaatacagatgaatagagattatacaaaatgaacagaaaaaaataaagagaaacagagcgtcagagaaatatggtacaccattaagcacacaaacatacatatattacaagtaccataaggagaggaaataaagagactcagaaaaattagaaaaataatgacaataaccttctcatatttgatggacaaggctaacttacaaatccaaaaggttcaacaaactccagtagaagaaactcaatgatccacacccagatgcatcatatttaaaatattaaaactaaagataaagaaaaaatcttgagagcatcaagcaaaacactactaatcatatctaaaggaaaccccaataagactaacagtgaacttctcaatagaaaaatatggagaacaaaattagtgggataacaaatttaaagtgctgaatgaaaaaaaaatacatcaaccaagtatcatatactcagtaactatctttcaaaaatgaaggcaaaataatgatgttcccatataataaaaacctgaaagaattcattgctaatagacctgacttacaagaaaatctaaaggaaattcttcaggctaaatcaaagtgacaccagagagtaatttgaattttcatgaaaaacaaagcattgtgttaaaggttaattgtgtaggtagtgacaaggaatatatttctttaccttttatctcttaactgatttaaaaagcaattgcaggctgggtgcagtggttcacacctataatctcagcactttgggaggccgaggcgggcggatcacctgaggttgggagttcgagaccagcatgaccaacatggagaaaccccatctctactaaaaatacaaagttagccgggagtgatgtcacatgcctgtaatcccagctactcgggaggctgaggcaggagaattgcttgaacccaggaggtggaagttgcagtgagctgagatcgccccattacactccagcctgggcaacaagagcaaaactccatctcaaaaaaataataataaaataaatcaaataaaaaaataaaaagcaattgcacagaacattaactacaggcctggcacagtggctcaagcctgtaatcccagcattttgggaggccaaggtgggcagatcacctgaggtcaggagttcaagaacagcctggccaacatggcaaaactccatctctacaaaaatacaaaaattagccaggcttggtggtgcacacctgtagtcccagccactctggaggctgaggcaggagaattgcttgaacccaggaggcagaggttgcagtgagccgagatcgcaccactgcactccagcctgggtgataaagcaagactccgtctcagaaaaagaaaaaaaaaaaaaataacattaactacaaaatttattgttgggcctataacatatagaaatttaatacatatgacaataacaccacataggaggggcgtcagaatgaagctgtattggagtaagaaaacgatacccaatggtaactcaagtacacagaaagaaatggtgagaataaaaaatggtaaatgagaaggttattttttaaaagccataaagatatttatgttctcttttcctctcttctttaaaagatataaggttatataaaatgataattataaaatatattattgggagattgagttctggcattacaatatgaggtgctctgttgactctgtcgcattaaaacaggtgaaccatttaaagcctctggaaatggtcctaagggcaaaacagaaaatgaagaaatatttattgaagaaaatccatagaaatttggtttaaaaaaaaaaaagcaagtctgtggtatctgaacaaaaactgccccctctatcccctctttccctctctccttcttccacccagcctagtgatctggggactccactccacactgctgcagctaagaacacagaactccttctcccctcagctcccagccagcaggctttcttctgaagggaacaggacttcagcatttctcatttgtccctaagctgtctgtggctgagaataagttccaggtgactgaggtcaagagatggggatcctgtcttccatccaatccccactcatggaagagaggatctaccatggtcatggtgtgttatgaacaccagagctccaatagcccttctctcagttctgagattgtagttccacaccagaaaaggcaaaccaagaggacctcaggctagtgacacctctccacctagcactcagctcctacagttgtgaaagtcatgcacaaagtcaagtcagctcctacaattgccattgtccctaccagagcccagagattttacctaaggggagaagcagcctataaaaatggatagctactaatctcttttcagagaggctgacttcatttgcaagagagcatggataagtgtaaacctaaaaacactctaaaaaaaattggaggttatgataaagaaaattgggagtagactcatgaatctaatgaagatacagccaagactataggctggctagtttgcaggagagaattggagaataagacagctggtaggagccttcctgtggtccgaaaaaagtatcaaacactgacctcagaaactatttcctgaaaagagccacactcagattagataaatttgtagaagaattcttgtcctagggagttgttgtaaacaacagaataattggccttcaattggtagaacttaacagctgggtgtggccaaggaaagaggataacagccctgccagtaccaccacagtcattccagggtgattgtgggcacacccaaagttgtgcctaaatgaggggcaacatcaaagatttaagactgcgtgtgtgctggaggggtaaacttcactaaaataatccagccaattactaaacagataagcaaataacaataacaagctccagaagggaagggctagtatccagagttggtaccagaaaacaagagtacactaaactcaaatcaagtagaaggaaggaaataataaaaatcagaacagaaattaataaaacagagaatggaaaaacaatagaaaaaatcaataaaaccaaaaggtagttctttgaaaagatcagaaaactgacaactctttggctagtttgaccagaaaaaaagcaagactcaattactagaatcaaaaattgaagggagaattactactgactttacagaactaaaaagcttataaaggaatactaaggacaattatatgccaacagattagataacttagatgaaatggacaaatttctaggaagacagaaactaccaacacagacccaagaagtaacagataaccttaacaagtgaagagactgaataagtaataaaaagactatccacaaagataagcctaggcccagatatcttcactgctgaattctactaaacattcaaagaggaattaatataaattcttaaaaaactcttcaagagaaaaagcagatgaggaagaaatactttccaaatcatttcatgaggccaatattaccctgactccaaagctagacaaagatatcacaagaaacctatacaacaatgtcttatttatatggatgcaaaaaccttcaagaaaattctagcaaactgaatgtagcaacatatacaaagaattataaaacatggcaagtggtatttatctgagagatgcagagttggctgaacatctgaaaatcaattaatgtaatacatcatatcaatagaataaaaaccaaacaatcaatgaccaccttaatcaacacagaaagagcatttgacaaaatccaatacttcttcatgataaaaccctgaataacatggaatagaagagaacttcctcaatttgataagggcttctatgacaaatccacactgccatcatttaaatgtgtacccccagagcattacattttggaaacttaatcccaatgcaaggtgttcagatgtggggcctaaaaggaagtgattaggtcatgagggcattgcccttatgaataaattaatgctgttatcactagattgagttccttataaaaaaatgagttcatccaactcttgctgtctctcatgcatgccctctctttgcccttccaccatggaatgatacagcaagaaagccctcaccagatgctgcccctcaatcttgaacttcccagcctcaaaaactgtgagccaataaatttctgtttattataaattagctagtctctgctattctgttatactcacacaaaactggctatgatacatataatgaaagactacaagctttccttttaagattagaaaaatgataagaatgtccactttcgtcaaatccactcaacattgtactagatattctagccagagaaattagccaagaaaaggaaatttaagacatccaaattggaaaggaagaaataaaactttctcttttcaagaatggcatgatcttatatatagaaaatcctaaggaatccactaaaaatctactaaaataataaataaggtcaaaaagtttgcaaggtataagatcaatatactgaaatgagttgtatttttatctgcttgcaataaacaatctgaaaatgacattgagcataacaattctatttccaataccataaaaagaataacatactttggaataaatttttaaaaacgaagtacaaaacttacactctgaaaactactaaatattgttgaaagaaattaaaggtctaaataaatgaaaaactacactacattcataaattcaaagacctaacatttttaagatggcagtacttcccaaactgagctatacatttgaagcaattcctactagaatctcagctgacttgtttgtacaaattgacaagctgattcaaaaattcatatgggacccagaattacaagggacccagaatactgaaaacaatccagaaaaagaagaataaagtacgagggctcacacttcttgatatggtttggctgtgtccccacccagtctcatctttctttttcttttttcttatttatttattttgagatggagtcttgctctgtcacccaggctggagtgcagtggtgcaatctcggctcactgcaacctctgcctcctgggttcaagtgattctcttgcctcagcctcccgagtagctgggactacaggtacccaccaccacgcctggctaatttttgtaatttttagtacaaacggggtttcaccatattggccaggctggtctggaactcctgacctcaagtgatctgcctgcctcagcctcccaaagtgctgggattacaggcatgagctgctgtgcccggccccagtctcatcttgaattgtagctcccataattcccatgtgttgtgggagggaccccatgggagataactgaatcatgggggcagtttcccccatactgttctcgtggtagtgaataagtctcatgaaatctaatggttttataggaggtttcctgttttgcttggctctcattctctcttgcccacccccgccgccaggtaaggagtccctttgctcttccttcatcttctgccatgattgtgaggcctccccagctatgtgaaactgagtcaattaaacctccttcctttataagttacccagtctcgagtatgtttttattagcagctgagaacagactagtacacttcccaatttaaaacttatttaaaaacaacagaaagcaagacagtcttgtaatggcacaaggatagacacacagagcaatggaatggcattgagagttcagaaatagaccgataaacctatgtttaactgatgtttgacaagggtgccaagacaattcaatagaaaatgaatcatcttttaaacaaatgttgcagggacaataggatacccatatgcaaaaagacttaaactggatccctatgtcacactgtatacaaaaattcactcaaaattatcaaagacttaaatgtgaacaataaaactactagaagaaaaagcaggtaaaccttaatgacttttgatttggtacaggattcttaggtatgataccaaaagcatgagtagcaaaagaaaaaatagatcaattggactgcataaaatgtaaaagttttgagcttcaaaagacactataaagtgaaaaggcaacccacagaacaggagaatttattttaaaaccatatatctgataagggatagtatctggatatgtaaagaaaattagaactcaatgataaagagaaaaacaagtcaatgaaaaaaaaacagacaaaggatatgagtagacatttatccaaacaatatatataaatggccaacaaacacatgaaaagatgattaacgtggctgggcgcagtggctcacgcctgtaatcccaacactttgggaggctgaggtgggcggatcacgaggtcaggagtttgagaccagcctggccaatatagtgaaaccctgtctccactaaaaaatacaaaaattagctgggcgtggtggtgtgcgcctacagtcccggatacttgggaggctgaggcaggagaatagcttgaacccaggagatggagggtgcagtgagccgagaccgcgccactgcactccagcctgggtgacagaacgagactgtttcaaaaaaaaaaaaaaggaagagagaaaagatggttgacataattagccatcgggggaaaatgcttatcaaaaccacaatgagataccacttcatggctagaatcaaagaatcaggtaacaacaagcattagtgaagatatggataaataaaaaccctcacacacagggtttttatttctccatatcttcatacatgctaggtgctaggaatgtaaaataatccagccactgtggaaagcagtctaatttttatttttattttaagttctggggttcatgtgcaggatatgcaggtttcttacataggtaaacgtgtgccatggtggtttgctgcacctatcaacccatcacctaggtattaagcccagcgtgcattagctgtttttcctaacgctctccatctccccagcataccccccaacaagccccaatatgtgttgttctcctccctgtgtccatgtgttctcattgttcagctcccacttataagtgaaaacatgcagtgtttggatttctgttcctgcattagtttgctgaggataatggctttcagctccatccatgtccctgcaaaggacatgatatcatttctttttatggctgcacagtattcctaccacattttctttatccagtctatcgctgatgggcatttaggttgattctatgtcttcgctattatgaatagtgctgcaataaacattcatttgcatgtctctatagtagaatgatttacattcctttgggtatatacccagtagtgggattgctgggtcaaatggtacttctgcttttaggtctttgaggaattgccacactgtcttccacaatggttgaattagtttacattcccgccaacagtataaaagcaataaatctgttttaaaaagaggaagtaacagtagttactggtgaagaccagtatgtcttgcaaaatgtactttggaaaatgattaagtgtataagtattctgtagaatgaaatatgtactaaagttgcatcttggattttcaaaagaatattttgttgtgtttgcaccatatgtaaacataatacgtataaaataatagacaacagggaaatgaatggaactatataaaagtaaatgtaaaatatattataagaattaacttactataaatatgaagtatattctgataacttatgatgtatatcataagtgccaaaacaaccacaatgagaataacttgaaaatagttgaaaatcattgaaaaattaaaacggtacactagaaaatattcattaaatacaaaaggggatagtaaaggaggtacaaaggaacaaagtagtcatgacacatacagaaaaaaaccaacaaaataaattccaccaaatcaatgacattaaatttaagtggattaaataacccagtcaaaaggcatagactgtcagattggataagaaaacaagatataactgcatgctatctacaagacacatatttatatatttaaatacaaacagattggaagtttaaaaaatggagaaagatgtaccacgcagagtaaccataagagagttgaagtggctatactaatattagacaaaatggactttatgacaaaaactgttatgagagtacaccctcccaagactaaaccaggaagaagttgaatccctgaatagaccaataacaggctctgaaattgaggcaataattaatagcttaccaaccaaaaaaagtccaggaccagacggattcacagccgaattctaccagaggtacaaggaggagctggtaccattccttctgaaactattccaatcaatagaaaaagagggaatcctccctaactcattttatgaggccaggatcgtcctgataccaaagccttactgaaacacaacaaaaaaagagaattttagaccaatatccctgatgaacatcaatgcaaaaatcctcaataaaatactggcaaaccgaatccagcagcacatcaaaaagcttatccaccatgatcaagtgggcatcatccctgggatgcaaggctggttcagtatacacaaatcaataaacgtaatccagcatataaacagaaccaaagacaaaaaccacatgattatcttaatagatgcagaaaaggcctttgacaaaattcaacagcccttcatgctaaaaattctcaataaattaaatattgatgggacgtatctcaaaataataagagctatttatgacaaacccacagccaatatcatactgaatgggcaaaaactagaagcattccctttgaaaactggcacaagacagggatgccctctctcatcactcctattcaacatagtgttggaagttctggcccgggcaatcacgcaggagaaagaaataaagggtattcaattaggaaaacaggaagtcaaattgtccttgtttacagatgacatgattctatatttagaaaaccccatcgtctcagccccaaatctccttaaactgataagcaacttcagcaaagtctcaggatacaaaatcaatgtgcaaaaatcacaagcattcttatacaacaataacagacaaacagagagccaaatcatgagtgaactcccattcacaattgcttcaaagagaataaaatacctaggaatccaactcacaagggatgtgaaggacctcttcaaggagaactacaaaccactgctcaatgaaataaaagaggacacaaacaaatggaagaacattccatgctcatggataggaagaatcaatatcgtgaaaatggccgtactgcccaaggtaatttatagattcaatgccatccccatcaagctaccattgacttttttcacagaattggaaaaaaactactttaaagttcatatggaaccaaaaaagagcccacattgccaagtcaatcctaagccaaaagaacaaagctggaggcatcacgctacctgacttcaaaccatactgcaaggctacagtaaccaaaacagcgtggtactgctaccaaaacagagatatagaccaatggaacagaacagagccctcagaaataataccacacatctacaactatctgatctttgacaaagctgacaaaaacaagaaatggggaaatgattccctatttaataaatggtgctgggaaaactggctagccatatgtagaaagctgaaactggatcccttccttacaccttatacaaaaattaattcaagatggattaaagacttacatgttagacctaaaaccataaaaaccctagaagaaaacctaggcaataccattcaggacataggcatgggcaaggactccatgtctaaaacaccaaaagcaatggcaacaaaagctaaaattgacaaatgggatctaattaaactaaagagcttctgcacagcaaaagaaactaccatcagagtgaacaggcagcctacagaatgggagaaaatttttgcaatctactcatctgacaaagggctaatatccagaatctacaatgaactcaaacaaatttacaagaaaaaagcaaacaaccccatcaaaaagtgggtgaaggatatgaacagacatttctgaaaagaagacatttatgcagccaaaaaacacatgaaaacatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactggaaactcgttcaaccattgtggaagtcagtgtggcgattcctcagggatctagaactagaaataccatttgacccagccatcccattactgggtatatacccaaaggattagaaatcatgctgctataaagacacatgcacatgtatgtttattgcagcactattcacaatagcaaagacttggaaccaagccaaatgtccaacaatgatagactggattaagaaaatgtggcacatatacaccatggaatactatgcagccataaaaaatgatgagttcatgtcctttgtagggacatggatgaagctggaaaccttcattctcagcaaactatcgcaaggacaaaaaaccaaacaccgcatgttctcactcataggtgggaattgaacaatgagaacacatggacacaggaaggggaacatcacacactggggactgttgtggggtcgggggagaggggagggatagcattaggagatatacctaatgctaaatgagttaatgggtgcagcacaccaacatggcacatgtgtacatatgtaacaaacctgcacgttgtgcacatgtaccctagaacttaaagtataatttaaaaaaactgttatgagagataaataagcatattttataatgataaaagggtcaatcaattgggaagataaaacaattacatgaacatccaaacaaaaagccacaaaagatatgaagcaaaaactgacaaaattaaaaggaagtataggcaactcaacaatgatagcaggggactctaatgctccactttcaataaaagacagaataaccaggcagaaaactaacaaagatgtaggttacttgaacaacagtcttgacttataccaatcagacctgacagacatgtatagagcaccttagcctagaactgtagaatacattcctccaaagcacacatggaacatcactaagataggccatatgttagggtataaaatagtctcaaaaaatgtaaaacaattgaaattatagaaatgtgtgatatcaacaatgaaattaaatgagaaaataacaaagccatttgaaaacatgcaaatatacaaaattaaatacactttttacttctattgtctgctcttttggggtcatatccaaaaaagtgttacccagaccagtgttgtacagctttccccctatattttatggtttcaggtcttatatttaagtctttaatctattttgagttgatttctgtagatggtgggacataagtatccaatttcattcttctgtatgtggacaaccagttttcccaacatcatttattgaagaaactgtcctttcttcattgtatgtccttgatgcctttgttgaaaatcaattgattgtaaatgtatgggtgtatttctgggctttatgtccctacagttggtccatgtgtctgtttttatgccagtaccatgctgttttgattataatcactttataataccggctctcacttatatgtggaatctaaaaacttgaattcatagaaatagagagtagaatggtggttactagaggctgagaaggggaagggaagagcggggaaaggggcaatggggtgttgtccaacaaataatacaaagtttaagatagaagtaagttttgagagctatgcacagcagggtgactagagtcaataatcatattatatatttcaaaataactaagagtaaatttcaaatatctcatgataaaaataataggtaaatgaggtgatatatatgttaatttgttttatttaatcattccacatatatgaaaacatcacattatatcccataagtgtatacaattatgatttgtcattaaaaatattaatttaaaaataaataaaaattaagggcattcttagagtgtgaaatagtatctcactgtggtttcgacttgcatttccctaatgactaatgatattgagcaccttttcatgtgcttttggtcatttgtataacatttttggtaggatgctagctgtgggattttaatagatgctctttatcacgtcaaagaaattttcttatctccctaatttgttgtaggttgttacctgagtgtttcccaggttttttatattacttcatctagtgaaatgatcatgtttttgccttttattccattaatgtgttacatttattaatttttaagtgttaaaccaaactttcaatcctatttatatgttataaacatattttatatgctaatatagttttataatggttgctttctaatctagtgtctttagaaaaagctaaaagatgggagaaaaatacatattataatttttaagaaaaatgtatgtaattataaacaatcttatttgccacttctaatattctttttgtgtatgaaattactctctggtttcatttccttactctattatacctcctttcacttcccccctgctttgtgctattattgtcaatattatactgttttatgctgttgctttttaaatatatgcttatattttcaaatagttttagatttaagacaaatttctaagatactatagagatttaccatccacctcacacacaatgccctatatgttattaacaacttatattagtatggtacatttgtaataattaactaataccgatacacttatatcattaaccaaactccatacttcattcaattttccttagttttttcctcatgttctttttctttggttccaggatcccaaccagcatatgacattacatttagttggcatatctctttaggctcttctttgcagtgacagtttttgactttccttgtttttgatgaccatgtcagtttccagtagtactggtcaggtattttgtagaataatcctcgattagtatttctctgctggtttcttcataattggagtggggttatgaatttttcgggggggggggcaatcacagaagtgaaataccattttcatcacagcatatcaaggaacacactaccaacatgacttatctcattgatgttaaccttggttttctggctaaggtagtgtttgccagctttcttcacttaaattacaattttttcctttccatactgtattctttcaaggaagtcactatgcacaggccccacttaaacagtgagaagttatgctctatgtccttgaggacagagtagtaacataaatcatttggaattcttctgcataaaatgtttgtatggttctccccatttatttatttaacccatatggactcatggacataaaataaatatcttggattataatctattagtactttattgatttactttttttctcaagttgttccagctttggccattgggacctctttcaattgactccagtgtccttttgacataacccattcagtagtgtgtgtgtgtgtgtgtgtgtgtgtgtgcactttagtacttccttacttcctggcactacgagattctccagactcatgtagttcctgatccagtcctagaaccagccattttttcaaggatccctggttcctttcattgaaaaatggtattagaatccaagttctgggcactagttgtgttcactgctgcttcagtatggttttgtttttcaaatcaactaagagaagagggagaaggaatatgtaattacactgtcttaatcactacacaattacctttaccagggctctttatggattcaaattattgtctgttgtcactttctttcagcttgaaggatttctttttatttatttatgtttttgagacagggcctcactctatcacccaggctagagtgcagtggtgtgatcatggctcactgcagccttaacccgggctcaagcgacccccacaccccacctcagcttcctgagtagctcagactataggcacgtgccactacaccccgctaattttaaaattttttgtagagatggggcccactatgttgcccaggctggtctggaactcctgggctcaagcgatcttcttgccttggcctcccaaagtgctgggattacaggcacgagttactgcccccagactgcctgaaatatttctttccgtttttctcataaggcaggtgctagcaacacattctcctaatctttgtttatctggaaacatctttatttcgcctacatttttgacgattagtttttccagatacagacatattggttgattttttttctttacgacttcgagtatgtcctccccttgtctcctgttacccactttttctgatgagaagtcagctgttgaaattactgtgattcctttgtatgtgataagtcattttcctctggctgctttcaggattttccctttggctttgaatttcagcattttgactatgatatgtctaggtatggatctgtttgagtttatcttacttggagctcactgatcttctttgatgtttagattaatgtctttcatcatatttggggattttaagccataatttctgtgactacatttctgcctttttctcttctccccttctggtactctcattacatatatgttgatatgtttgtttcccacacatatatgaagctctgttcatttttcttccttctgtttttctttctctattaatctgtcttctgcttcagtaatctctcttctgcctcttctgccatgatataaaatattgttggccttaagaatttttgttttgcttattttattttcaagtccagaatttgcatgtggttctttttaaaaaataagttctatcacttcattgatattctttatttgatgagttgttatcatcacactttcctttagttcataaaacacagttttctttagttttttggatatatttataatagctgctttaaagtccttgtctgtcacgtacaacatctgagctccctcaaaggtgatttatattgcctatttcctgtccatggtcacacttaacttattttttggcaatgctcataatttttgttgaaaatttgacattttaaataatgtattgtagtaactctgaattctgtttacctatcccacccccataacctgggctttgtttttgtttctgctttttctctatttctcttcagtgtcttgcctggactaattctctctgaagtctatttcatctgtagtgtacagtctctgatgtcatgttcatttctcttcttgttttacttttaagtctggctttctaggagtcatcttatatcaaaaggtcacaggtttttcttaagttcctagatccagtaaagcttctatcttttgccaatgtatctttgtatggattggggaatgctttcatacttcaggaagtctttaattttatcctgcattcaaatagggtttagcagctcataaatatcatatctctggtagctcccacacaggtttagcctagtgtgtgtgtacagccttccagaccaatagacaaatgtgatcttagcagggcatttttaaactctttccacaggtctctctctgaaatgtctggctggtcttttttcttctagctgctactaatatgtaattctctaatattcactactataatctctgctgttttcaacaataactttaggcatgaattccttcatgctctgttctaaagtcagtcagtccccataggctatgttactatttggagctggatgaggagagaatgatatggcagcctgcttcttctacagtgacatctctgctctatgagccccctgaagtccttgtctgacaaaaacaaaaaaacaaaaaaaaaactgggccctcgacttgggagtggggaaataggagccctggtcttctccaactgccattcacagtttgctgcaactgtctagggtagtgccttcatcttaagagtgggaactgagcacggaatgggaacccccaatcttcttgttttttgtggccaagaataaatcttgtacaacagagaactggagatggaagaatgagagtcactagcagcctgatcattctggaatgaaactatagctctataatcaacagctggtaagaaagagaccccctgttttctcggttgtactcacctggaataaatcttctgcaacataaagttgggaggaggaatggaagcagttccttgctcaaatgccaattgttcttaccaaggttccatagatttttcttaaataagtgattctcaatttgttgcatgaccttgagccagtttccagatactttgaatggttgttttacatcatcttctaccattttaatggttgttttactggtgagagggtttgttgagctcttcacactagaagttggtctgtcacaattgttaattcaacacatgtttagcacacacctactatgtactaggtgttatatacactggatttgtttgaattaacagatttattaatgtatagttgatatacattaaactgcacatatttaaagtatacaatttgattatctttgacatatgtaccttctattactataatcaagatggtgaacttacccattaatcccaaaagatttcttgtgccctttgtattgccacccagttttctctgtccccctccctctggtaaccattaattagcttctgtcactatagattagtttttgcacctgtttttaatttacaaagctgattggtggtgaagtttctcttttaccaggggaccaccctcagcccaattgctcttttcttatgagcagaacatttttagagattttctttttgcctctaggtcaaaattactcaagagaaaacaaagaatccagccaccgccatctctgcaaagggagttttagtaaccagctcaccagattcccaagtatatgtttccagacctccaaaaaaggcaacagcatttcactcctgtttgagttggtaaattcaagtccttgcatttaaggagttataggctacagtgtaagaaaagccttaggattcttcccttacagtggagaagggttgagaagtcaccagggttcttctcactgtctttgcttaggtaccagcaagggctattaagcaacccaatgttttcccattgtccttcacatgaatgattataaactcccagcacagtctgagggactcagggtggtccagtttctacagagacccaggaattgaatccccaaactatacacatgctattacttctttcactcttcaagaggaaaatgatatggcaactccagcaggcttagctgttatcaactagaactgatcctaagagcaatgatttattgcttgcctaccatatatcaagcactgggctaggtggtatagaattgttaatctcatttataatacaaccaatccacaaagttggtacaattttttcccattgtacacaagggaaagctgaggtaaaaggaggtgaaaggacttgtcccagatcatattcatagtgactagcacaggagaaactgaaactcagatctgacacttaggttaccctctatccactgtactataatgtcagattgctaagcttagggatttccctccacatcccaaaagcctctcataagaggagaattccaactatatggcttttcatctgtgtggcaataaatgccacctgggaccctgtatttttattgcttttatacaagcctatatcactctgtcagacgaattaaaagtgctaattcacataaatgcccctcttcaaaaagagcatgggaaatatccagaaaacccatgaatgaattcagaatcaggctgtgactttgactgtttacatgacagcgaaccacaaatgctggattacattccaagcatctgtgtttagcaccttggaatcttgtaatattaaaaaaaagttctgacaaatagctatccatggaatgtagaactctaactcagttatgctgtgtcagaaattggcgaagatgcttactgcaatatttttacaagggctatcttacaaaattgaggccagtatgccatcttccagtttgtgctgcatctcatgcaggtttgtcattcattaaaaggctacaaagagattaaatggaatagggctacttggctcaaacaagaaagaattcaagtttaaagcagttactgactctcctcagtagagggcagtggtgggcagggcaagactggcaggaggagaaggggggaacattaatttctgtggtgtacccactaagtgctcagatacagtgcttaatgctttacagacagtatctcatgaatcatgggtattaccctataaaggaaggattattagcaccattttagcctcaaagaggttaaatgaattgaacgcagatctggtgccatctagttcaactattccatgctgttgcctgaaaagtactgctttattctaaagtgtcaaaactggaagcttatactgatgaactgaaagaggagactctcctaggatagagtaggtcccatatatgatagtatcctgaaagatcgaggctggctggaacaatggaaaacatttaacaaagataacatgtaaaaattataaacttcagagccagtgacaaggtggaaatgatctacaagaagtggttcagaggattggaaaactgacatatggggaacagttgagagacttggagaagattagaccaggatgcctggcactagggaggtgttcatacatgttggaaaaactgaatgtagaaaatatcatgagaaacctaacattgtcttttaactacctaaagggcaattagttatcaagaaggtacatactgttttgtgtggttccaaaggctaggacctagatcagctggagggagattttagtttcttaaaaggaataatctactaaaaaacataaaactctaagagagagagagcaactcaaaactgacatgagttgctgtgtgagattcagttgtaaagatgacctccaggaacccttccaactccaggaagttcagattttgtgctgattaagactcccgggatggcttctttactcttgtcaagtgatgttcttaaaactttccaagaaagaactagttggtcccccatacttaggagccaaagtattcagaccattagaattaactctcctaagaggaccttatccacacatctccaaagaaattataggagaaattctgagactgcctcacaagagggagccattgctgttccactggaatctgtatattggaccaattaaagactacaaatgtaccttttattcaaagaaacaaataaacatagtcaaaaagtttagccatttcattaaagatgctgggcccagtggctcacacctgtaatcccagcactttgggaggccaaggctggtggattgcttgagctctgcagttcaagaccagcccgggcaacatggtgaaaccccacctctacaaaaaatccaaaaaaatagctgagtatggtggtgcacacctgtagtcccaactactggggaggctgaggtgggaggattgcttgagcccaggagatggaggctgcagtgagccgtgatcacaccattgcacttcagcgtgggtgccacagtgagatcctgtgtcaaaaaacaatacaaataaaaagagaagaggccactgaaatacacacttataaaatatgataccaaataaagcctaatgatgatggaatctaaagaatctaaccctagccatatcagaataaataagtcagtcactcactcatcagcatttccctggttcatcttattatatgccgggctttgttctgactaatggagataacagagagaagttagaaacaattaccacctttaaaagggtcacagtttagtagtagagagatatcttcatagataatttactccctgtatagagcaatgggaggatagagatctatacaacaggctgtagaaccacagaagtagtagggatggaatgaaggaaaggttatacagagaatatatcatttgagctagaccttaaaaaatagatgagagttcaccatgtagaaagaggaagggtacattctagcaaagggtacaacatgtgcaaagaaaaagaggtagggaagatcttgggatatttaagaaagatagtttgtcaggtatgggttggctagggcataagatgtatgagaaagtggtgaatcaatttcttcatattcttgctatggagagattctctctaaaatggcatgttcagcaagcttaccaactgctgataccctgaactggcttccactgatgaccgcagactgggctgtgcgcttgccactagaaatctggtttttagaagacctccatctactatctctctcttgagggttaccaaagccacagtgaactggaattggacaacagggaagcttcttgaggacctcaacttgaccatagccaccaacacaagaggacagacatctcattatcttggcctcttccaggtggcacttctaggaatggaatgattgatatagaggtctttgctataagctatgcccagatcttcttaccatgaaatcctgagaccacaaaagaatgccatatgtgccagctcacctggccaacatcagttactaaaggcccatgcgtttccagcaggaagtgtccaaagggcttcagtcaggaatccttactcctattatttttttgatacggagtctcactctgttgcccaggctggagtgctgtggcgcaatctcagctcactgcaaccttcgccgcctgggttcaagtgattctcatgcctcagcctcccccgagtagctgggattacaggcgactgccaccacacctggctaatttttgtatttttagtagagatggggtttcaccatgttggccgggctgctctcgaactcctgacctcaggtgatccactcgcctcggcctcccaaagtgctgggattacaggcgtgagccactgtgcctggtcccttcctactattatgacagacccttcctaaagggatgaacttctgaatttgcgggtagcctccttcttaaaatgttcaatgatctcctgtttctgctgctatgcttctcctgaagcagccaaaattccaaatcatttctagcagtagatctgcattgacctcagctgattttaagacctatatgggaagcaatcttatttataatatttatcatccttcatcatcctcaagcaaacgatcagagtgggaaatgctagaaagtagtacagtgctgggcatttaataaaagttctctaaccatagcttgattaaggttgtcctaaaatgggccactagaagatgctggccattaagatttgacaaaacattaacgtatcacttaatatgtcactccatattcaacaataggagtttgtcttgctcagtaaaaatgggatgaaattacaaggcttgccttcaccatctttaactcaaggtttcataaagacatacatatagaaaatgcatttttaaaagcagtattaacttacacctatctttattcttttttgttaggacagttagttttgtcaagagctatgaaacaatgatagaatcctaccactctaatcgaactcatggagtctatgccaaagagagtccacaatgtagatgaacccatgtgatactaccactttggtcaactgtgaaattattgctcctagggtgatgtgacaataaaacaacaaaacaatggaagctttatcttccagaactatcaaggcattgaatcctcagctatagctcctgggggaacaacagagaactagtatttcttcacctaccagtagaactcagacatagccttgtcaaaatggtgtttctctatcactagggcaaaaaaatattagctaaggagctaatgacattctgtacgtcaggaagatctggggctcactgtcagatatttcgtcctttgtggggaaggtttctataataatggtattttgcaacatggggctgtgttgttgacagctccttgtctacatttcttactatccatcatgacactgaccaacaccatcagggaaatacaagatctgctctgaccttagaactgttcctgatcatgcaaaatacattctgtcctgacttcatattagcagtgtttaattataattaatacagttatttctttgttacttgagagtacaagtcatgtgtttctagctaaacagtaagatctaagacagtagtatagggcagtgggaagaatacactttggagtaagacatttccaagtttgaaccccactcccgagctagctatgtaagtcacataagttctgtgagttttagtcccctcatctataaagtgggtaagatgctatcttgacctacaggatggccctaagaatatgtaacgtgcctggcacatttctgtaaatgaaagttactttcccctttcctctgtaccatatctgcatctgataatacaatacaggattttctgatcaggtgttcaccaaatcttgactaaacacagagaaaaaacattttagtccatgctttttgtgcccaatattatagggattccctgtcctgatctccctccagctttaaagccaggtttagtcattcctgactgcacatggttcttcaacagaagactaagtcctctggcaaatttggtccataagcacttcctattctgacagagaagacaggttaagtttcacccacatcttaatcttaaggaatgtgcctattttcttcttttttgatacactagcttagagtcacatatctctggggaaagcagacaacacaatttgagatggccacctgccttacttttcagatgattaattccattagtcagattgccattacagtcagactgagggtatgcctgatacagcttaagggctgaggggttcttcatgaaaaatactactctaccatctctcttttcctttccaccctaaaaggttaaaaaaagaaacttaccttctacaaggaccctctttgaaacatatttctaagtctctaatcaaggaagtctacctaaagcctaagacaactttaaaagccctttatgtgagtaaatggatttcaaatattgtgctctaaaggagaaaaatcaaattccaggttggaatcctcatttatgccagacagcccctgcaactacagggaaactctgtgatggaaattgtcaggtcagctcagtgcctacaggccccattaatttatgtctccttcttctgagaggacatgaaatggggagaatctttttacttgattattcatagctatgcttttggggctgccaactcactctccatactttacatagctgacccatgacagcacacacctaatctcacatagggtcacataccctcacttatatagttatacatcccctagactatagagagagattgggaacctctgagagatggagtgtcttgggagaatagactgcatggtgaagaagggcagagaacagggaaacgagaaataattcccagactattagctagttctttgttggtctttcctctagattacgtaaaggacttgagtggcatgtgcttcttctttgatgaccctgaagtccctaccttaaattgcttcaggcctcagttcacagacactctgcagagatatgtaacctccttgccttggagaatatttgcagaatcaaaatgatgtcctgctttaagagagttactctcccaaatccagtggaggagactctgaaggagcttgaaggactgttaatgttacatcgggttttaatctcataatttgtaacctatatgggtaataatttaaagaacagctttctgcaaaacaaattgttattgggctcactgcagtttatgtgcctttcctcatcacttcacagaaaggtttctaatacatttcagtatacctgggagcaaggcctagcactgagctgtccagtacagtagccatccactagccacgtgtgactaatgagcacttaaatgtgactggtgtaaattgacacacacttgtcaagtttaatatcacaccagatttcaaagacttaatattaaaaaagaacacaaaatatctcattagtaacttttatactgattccatgttgaaatgttaatattttagatatattgagtagttaactaaaatatgttattaacatttgtctcccttgtttctttttacctttttaatgtgattacttgaaaatttaaaagggcatatacgtattgttatattgttttatgtttatgaattttgtcatacctaactcctaaagtttttccttttgctttcggtatttgagatgctcccaagaaaagctagctgtgcagctttgggaaacctacttaagctctccaggccaaatggggctaattgtctatttcataacgttattaatttcataaggatttaatgggctaatgcatacataacgcttatctctgtactctgtacctggcacttagtaaaaactcaacaattgacaggtattctgcccaaagatagtgaaaagcgcttcccaaagaaatgttatacatcttaccatccaggtaacatcatttttctttacataactgctaatgagatccttagctgagaaaaatgtgagaagcctcagtgttggttcctcatggatctctgagatgatgcttggttttaagcagtagccaggcttaggaaggagctacagaactggaggcaaagaattcattctcccatttattcatctatccaatcattcaacacttaatttattgagtctcaagcactgttctatagacaatgggaatataacaataaacaaaacaggcaaagattcctgcccttatagacttttctttctggtaaaaataagtcatagatttgttttcaaaagctcgctccaatcatttatattcggaacttgattcagaaaccactttctccatagacagcactgacctctcaaatggtcattctaggtctcacctaaagcctgtaaggtatgtgttgttccagcatctctgccactccccagaatagtcaagaattactagccaatcaatgcagtcccctccttaggctcaaatcaatcaaaaggtttgtaggctccctccacataccatgcatcagtcttcactgatctcttacctgccacaaagagattaacccactatcctctagtatgtcaaatgggctacaagtgacgtgccaaaccctcaggaagcaaacaatatccacagcactaccaccagaaaagtacattatctcactgtctccactaccagttttgtcccaggaggtatcatggtgcaatgaaagtagcatgggctttggcaccaaaatgaccaggattcaaatcctagctctgcagtgcactgtgacttcaggcagatcattttaactctccattccttcatctgctgtcctgtgaaaaggctatcttcctcacaggattatgggaatgaatatctaacaggcacagtgcctggcacagttagtattccagaagcattagttttcttcccacattccttccaagttgggtggtattttagaaacagcatgaaagctattcttgtatggattaggactaagcaattgcctcttagtggagggctcacactggctagctttccagtgaagtattcagtaatatcattttagcaacttgaaactggccatggtgggagtatatccgctatagaaaccacaagtgctacaaattaggttttacttatttactgtttttctggagagctggtttgccagcactccactagcttaaaccgcaagacacatggacaactcagggacaaagataaggcaattacacacttgtcattttgaaacagagacccttctacagactgggcaaaaattgccatgaaatatagctactcggtccttctctacagaatctttcatgtggcacattaaacatacttattgccccctgaatataaaaaccagcaacataagacacgacaagtatcatcacagggccaagttcacagtaggtgctcagtaaacatctgtcaaatacataaacaagcccaggataaattatttgccacttttcatcaatgaaatagaagcagtggtttgaaaaaatgaaatgagactcaggagaaaagaactttaggatagaggtgaacgcacaagccagaatgctgaatgagaaagttctggaagggtgaacaggctcaaggcaagggaaagttggaacacagaatccagagaaataggtccatggtagtagggtacaggagaggtacatgggggaaactgacaaatggaacaaggtcctgaaatagaaatagaaattcatgagctatactttatctgggaaggaattttataatgttttggtggagatgttctttataaaattatcaaaatttttatcttcttaaaccactgcactttaacaacttaaatatataatttacatatgataaaattcacccatctaaagcataaaatataatgaattttagcatttacagagctgtgcaaccatcaccacaatctaattttagaatatgtccattatcctaaacagaaaccttgtgcaatttatattcagtccccattcctaacacccagccccaagcaaccactaatcactttctgcctccaaagatttgtcttttttgaacatttcatatacaataaatggaatcatacaatatgtggccttatgtgtcttcttccactgagcatgtttttgaggttcattcatatagtagcatataatactgcttcatttcttttcactgccgaacaatattctattgtatgattataccacatattatttatccactcagaagttgaggatgtttggggtgtttctgccttttggcttgtgtgagtcatgatgctatgatatgaacattcaggtacaactttttgtgcagacatatgttttcatttatcttgtgtatacacctatgagtgaaagttctgagtcatacgatagctctatgtttaacatttttagaaactgctaaactgttttccaaagaactacaccattttgcattcgtatcagcaatgtatgagagtgttctgatatgccacatccttgacaacacttatttttgtctaatagatagccattccagtggatgagaaatgtaatctcatcatggttttgattttcattttcctaatgactaatgatgttgagtatctgttcacatgtttatttgccatttatatatattctttggataaatgtctattcaaattcttatcctgctttttaatgtataatctgtcttattactgagttgtaagaggctttatattttctgaatctaaagactttgtatgatatatgatttataggtatagtctctcagtctttgaggtgttatttcactttctggatggtatctttaaagtgtgaaggttttaaattttaagtccagcttacatccagcttatcatgtttttatgacttgtggttttgttgttgtatcttagaaatctttgtgtaactcaagatcacagagatttactcctatgttttcttctaagagttttatagtttaagctcttatacttaggtatatggtacacttttgagttaattggtgtgtatggtgtgaagtcaaagatcaaattcattattttgcatgtgaatattctaccgcctgaacaccaattgttgaaaaaactatttctttccctttgaattttcttggcaagtttgcccaaaatcagttgatcacacatgtaaaggcttatttctgggatctcaactgattgccattatctatatgtctttccttaagccagtagcacactgacttgactattgtggccttgtcataaattttgaaattggccactgtaggtcctccaagtttgatctttttaaagactgttttggctactctgggtttcttgcatttctctgtgtattttagaatcagcttgtaattttctgaaacaaaaaagtcatctcatctgaggccaggtgcagtggctcatgcctgtaatcccagcactttgggaggccaaggtgggtggatcacttgaggtcaggatatcgagatcagcctggccaacatggtgaaacccagtctctactaaaaatacaaaaattagccaggcgtggtggcacagtcctgcagtcccagctactcgggaggctgaggcaagagaatcgcttgaacccgggaggtggaggttgcagtgagccaaggtcacgccactgcactccagcctgggtgacagagcaagactccatctcaaaaaaaaaaaaaaagtcatctgagatttttctagggattgtattgaatttgtagatccatctgggaagtacagccattttaataatattatatcttctaattcacaaacatgggatatctttctacttatttaagtctttcttttctttcactggtgtcttatagttttcagtgtacaaaatacttttttgtcaaatgtattcttaattattccattttttgatgctattgtgaatgaaaatgttttcttaatttcattttcagattattactataaagacatagaattgattttttatgttgatgtcatatcctacagacatgatgaaaaattatgttttactgtataaaatataatattatctatgaataaagacaaattagctttttttgtctaattgccttggatagaatctgtaatgcaatgttgaataaaactggtaagtgtagacatatttgtcttgttcccatcttaaagcaaaagaattcagtctttctctattaagtatgatgctacctgtaaggtttttgtatatgccctttatcagcttaaggaaattcccttctattcctaacttgttgagggtttttgtcatgaaaaggtgatggattgtgtcaaattattcttctgcatgtatgcagtttatcatgttgtttttgtactttattctactaatgcaatgtttacattcattgattttttgcatgttaaaacagccttgcattcctaaggtaaattccacttggtcatggcgtataattatttttacatattgttagattcagtttgcaagtattttgttctagatttttgcatctattttcataaggaatactggtctatagttttcttttcttgtagaatgagttgacgcttatttcctctattttctgggagagtttgtgaagtattggtattaactcttcttttaatgtttggtagaatttattagtaaaactctttggacctgggcttttctttatgggaagatttttaaactactaattcaatcttcatacttgtctgttcaggttttctattatttcttgagcagttttcataatttgcattttccaggaatgtatccattttatctaagttatctaatttgtttgcatacagttgtttggagtgctcctttatactttttaattaatttttctgtaagttctgaagtgatgttccctcctcaattcttgaaatctgtaatttgagtcttctctttgtcaatatattttgttgattgttatgggatgaactgtccatccaaacttcgtaggttgaagccctaactcaacagtatctcagaacatgaatgaatttggagataaatcctttaaagagatagttacgttaaaatgaggctgttaaagtgggctctactccaatttgaaaggtatctttataagaacagaaaattacgacacatattgagacactagacacatgcacatgcagaaaggaaagaccaggtgaaaacatattgaaaaggtgagccacctgcaatccaaaaagagaggcctcaggagaaaccaaacttactgacaccttgatcttatactttcagtctccagaaatgtgagaaaattgatttctgttatttaagccaccaagtctgtggtaatttgttatggcagtgctagcaaacgatcaattttgttgatattttcagacaaccaacttttggtctcatcgattttctatgctgtttttctgctatttcatttatttcaactctagtaattatcatattattggtttccttccactggttttgcatttacattgcaaaattccttctgaatctcctagtttcttaaggcagattaggtcattggttttacattttttcttctttttaatataggcatttacagcttcaaatttccctgtgactactatttttcctgcagtctgtaagttttgatgtgttgtgttttcattttcattaatcttattttcttatttcttcagtgatttattctttgacccactggttatttaggagtatattgtttaattcccacatatttgtgaatttcccaaatttccatctgttgttgacttctaatttaattatattgtgatctgcaaatttactgcatatgatttctattcttttaagtttgttgagacttgttttatggcctagcatatgggtctatcctggagattgttccacatacacttgagaagaatgtatattcttctgtggttgggtggagtggtctgcaaatatctgttaggtctatttaaattattgtgttgttcaagtcctctattttcttgttgatcttctaatcattttatccattattgaaaatgagtattgaaatctccaactattattgttgaattgtctattttatcttcaattctgttaatttttgcttcatgtatttttgggacctgttgttaagtatataaatatttaatatgtttgttatattttcctgattaattgacccttttatcattataaaatatttattttttatctctagtaactttttttttttttttttaagagacaggtctctgtcacccaggctagagtgcatggagtgtagtggtacaatcatagctcactgcagcctcaaactcctgggcccaagcaatcctcctacatcagcctcacaagtagctgggactacaggtacccatcaccatgtctagctaattttctatctttctttagggatgggatcttactatattgctcagaccggtcttgaactcctggcctcaagcaatcctcctgcctcagccttccaagtagctgggattacagacatgaacaagcacacctgacaacatttttttttgttttaatacgtattttgtgtgataacactaacagctactccagctgtccgatggttgcagtttacatggtatatctttctctgttattttagttttaacctatttgtatctttgaattgaaggtacatctctttttgacagcatacagttagacctcagtttttttatccagtctgagaatttctttctttttatcaggttatttactccattcacattcacattattattaatacagttgaattaatatctgccatttgctattagttttccatatgtcgtattttacaaaatattttctgtcccttctttaccgccttgttttgtatgaaataggtattttccaatgtagcattttaatttctttattaaattttaaaccctatttttttaacttttattttaggttcagggatacatgtgaaggtttgttatataggtaaactcatgccatgggggtttgttatacagattatttcattactcaggtattaagcctagtacccaatagttattttttctttttctttccctcctctcaccctccatcctcaagcagaccccagtatctgttgttcccttgtgttcatgagttcccatcattcacctcccacttacaagtgagaacatgcagtatttggttttctgttcctgcgttagtttcctaaggataatagcctccagctccatctatgtttcctcaaaagctatgatactaattcacactcccaccaacagtgtataggtgtccccttttctctacaacctttccagtatctgttatttttttactttttaataatagccattctgactggttaagatggtatctcattgtggttttgatttgcatttttctaatgctcagtgatattgagcttttcattcatctgcttgcttgttggccacatgtatatcttctttttttttgagacggagtctcgctctgtcacccaagctggagtgcagtggcatgacctcggcttactgcaaccttcacctcctgggttcaagcgattctcctgcctcaacctcccgagtagctaggactacaggcctgcaccaccacgcctggcttttttgtatttttagtagagacggggtttcaccatgttggccaggctagtctcgaactcctgacctcagataatccacctgccttggcctcccaaagtgctgggattacaagcgtgagccactgcgcctggcccacatgtatgtcttcttttcaaaagtatctgctcatgtcctttgcctcctttttaatggagttgtttaaactctatttttaaagttatattcttatttattgctctaggaattacaatatacatcttatattctacttcagttttatactaacttaattacagtaagatatttacaaatttgctctactatagctccatttcctccttcttcctttgtgtttttattttcatatatattttgtctatatacagtacaaactcaacagtgcagtgttataattgttgctttaaataatcttatgctgtttgaaggaacaaaaaagaaataaaactatacttataaagttttatgttgagcttcttatttatgatttctggtactctttatttcttcctgtgcatttgagagactacctgatgtcattgtcttgctccactgcaacttccttcccttcagcctactctgtgctgtcattgttaagtatctctctatatgttacaggcccccaattcaattatactgctattgttttgtgctattgtttttaaatcaattaagggaagataagaatatgtaattatgctgtcttttatagttactacataattacatttatcagcactcttagttttttttcatgtggatatgaattactgtgtgacatcacttcctttcagcctgaataacttccttcgatatttcttgtaagggaagtctgacatcgacaaattatctccgtctttgtttatctgagaatgtctttattttgcctatagttctgaaaggtagttttgccagatacaggattcttggttgatatctttatccttcaagcactttgattatgtcatccctttgccttctggtctccattttctttctgatgagaagtcagctattcatctttttggagttcacttgtacattatgagtcatttattttcttgctgctcttatgacttttccttttgtctttggcttctgacattttaactgtaatatacttaggtgtatatctttatgcctttatccttcttggaatttcttgaggattttccatatgtagattaacatttttcatcatgttttggaaattttcagctattatgcattcatttttttcctgccccatttatactcttctccttgcagtacttttatcatgtgtatgttgaagcacttaatggtgtctcagatttctggagctctgttcatttcctttattcttttcttctgttcttcagagtgtataatctctaattatctatcttcaaattcattctttcttcttccagccttatttactgcagagcccctccagtaaattgttcctttccattgttgtaatttacaactccagaattttcatttgatttttcttctataatttctctctttattatctctttgacttgttattttctcattttaggctggttcctttagttctttgaacatacttataatagttattttgaagtgtttgtgtctgtctgatatattatctacccctacaacctcacacgttgtttatattgcctgcttttttttgtacaatggtcacactattctgtttctttgcatgtttcataattgtttgagaactgggcattttagatgatatactgtaacaaatctagattctgattagctttcccaccactaccatggggcttgctgtttggtggtttgcctggactaatcttgtgaagtctaatttccctgcactgtgaaatctccaatgttactgctcagttttttctccttggtttgtttctttgttacctcagagtagctcctgggtcagtataacttaatatttacctagtgattggtcagaattgtgcttatgccccttaagccttaatgatatagaactttgatgatggatttctgtgtggcttggggaatacttataaattggctccatgttcaagcagtgactagtagctctcaagtacactttctggttgcttttgagtcaatgcagtgtagcacatgtgcatgccatcctgacccccagtgatcttaacaggactctttttagctgtctctccccttgattctgtctgttaaacttctggctggtctgccatttaattcgttgcttctagttacatgaactattagcttcctactagttgttcaacataaagatctctaccgtttttgaaaacaccttttaggagtgagtttttccattctctgttccaaataaagtcagccctcaacagcgctgctgacctgccagtcttccagtctttcctaacaccctgagcagaatttttgtcgttccttactggaatgaagatatggtagtagtctgattctacctaagtgatatcaccctataagcaggagctggaggatggggatggtagccccatctttttgatctgtacctcctggtatggaacttctaccctacaagtgggatctggggtggggaaggaacctcagtcttcttgactacgccaacccaaaatagagcttctaaaacatgaagctgagagtggggggaaaaagacactgcgagtggggggaaaaagagcagcctgtctctcttcaggtgaaactgtagtcttatgactaggagcttggcataaaggatgccccatcttcttggctatacctgcccaaagtatagcttccacgacaaagagctgggttggggagaggtgatgacagctagctggacttcctttattcttattgagacctagtagattttcttgaattaattcatctcaatatactgaattccctgaggtcaatttccagagactttaaatagttgttttcaataattttcaccagttaagtggttgcttcaatggggagagaatatgtttagctcctcacacagccattctggaagtcctgctcctaaaccactgatttttaagccttttattatgcttttcttggcttttggaaaccaacttgtattagtccattttcatactgctatgaagaaatacatgagactgggtaatttataagaaaaaaaggtttaatggactcacaattccacatggctggggaggccccacgatcatggcagaaggcgaaggagaagcaaaggcatgacttacatggcagcaggcaatagagcatgtgcaagggaacttccctttataaaaccatcagatcctcatgagacttattcactgtcacgagaacagcacaggaaaaatcagctcccatgattcaactacctcccactaggtccctcccatgacacatggcaattatgggagctacaatttaagatgagatttgggtggggacacagccagaccatatcacaatccatttttagatttgcagatgagttggttctgcttaccaatggtttaatttctgtagtgtaggctttatgtatatagaccaacaaacacaatgcccacaacaagaaagaaaatatttcacaaattcattaggtgtatgctcatatgagtgactacattcaagttaattttcggtctcatgcatatagcctcctcattttccagcagaaagtaaaaatgagttgttttcccataactgaatatccaagatacccaaactttattccatcaagtaccagacatttcattttagtcatgttggtggactcactctaaaatatctccttagtaacttacacaaaggcaggtgattctaactacttgaaagggagaatgaaggattgctaaaaaggaagcaggtacaatatatgaaagacatcacaaactttgccaattatagagatcagtcagacacattgatagacactgtaaagagtataattgatactgccaaggatcccaaatatcaaatggtgcacacatctacctcattcacatttccgtaaactgtctggcaaacagataaacaacagccttccaaatgacatgaactggccgagaaatctatgctgatcatggcactgttatacccttaaactttctgcaggcccaaacaatgaaagaaccaatgcctcctaacatttaaagtctactttaaactagccctaacctttctttccagactcaatctccactgttccccaatttgtaactttctccaaccacatttatttccctttctactaccttcacctggtatgtttccttcaccgtcatcaccctgtcttgctagtctgaaagttccttaacggaagggattgtgttttgtccatctctgcccctaggacccaccacaaggcctgtcagaatattcagtacatttttttaatgaatgaatttctgccatctgaaccatctgaacccttaaatgtcacctccaccttggcgcttttcctggtctcaaatgggtcaagtctctcacctgttgaaattcccacagcttcttgcttctaacctttttaatgatacctatcatagtttcccttgtgctttgttataattatttaaatacctacattattcctgccaccactactttttccctcttcagagaaagagggcgaacaagagacagaaagacacacacacacacaggatcacagtcttaaagagcatgaactttgcctcatttaaaaaaaaaactttcttgtggaacttaacacaatgcttatcacataggagacataggaggagttcaagaaatatttgccaaattgaattgctgaaacatttggatatcagtatggagattttactttagatccatacctcataccatacacttgaataaattccagatgggcccaaaaattaaacacaaaaaagaaaaaaacaccctgggggagtggggaagacagaatcacatatttgtcccagctgttgaggagtggtaaatttctgaatattgaaaaatgaaagaaacattagagacaggatggatggatttgaatatataaatgtaaaaaggaatagttttgcatagtgaaatatgataaagcatacataaaaatgaaagcaataaaattggaaaaatatgtgacaaatataaatgatgaagctgactatccaaaatatagagaatggataaaaatatataaggtcattacccagattttacttgagaagtggtgaaagaagatgaacgaggaaacagcaaattatgacactaaaaaatgaaaagcctcattaaataaaattaaaacaaatggatagtatacttatatacctactaaactagcaaaaaggttaaaaatgataacattcagtgctgcagggatctgtgaaaacaggcacacttatgcagtttaatcttttgggagtacaatctggcaacatgtaacagcagctataaaacagctcataccttttggcctcgttattacacatttggtaagataccagaaagcaataactctaaacagaagaaatgcaatttgtgcagaaccattcacagcatcactttttataagagtaaaaattttaaaataacttaaatctccaataatagaatggctaagcaaaatctggcatgtcaataccacacaatcttatattttcatgtgtaagggtatctgcctattccacattgccaggtctttgcttttatgatttctccatcctgggtgtctgttacttagctgtcactgtgtctatttctagagtaaactacctcctcaaacccacccatcctgccgccccaaattctaatttgctgctgtaactgaggaaatatcaggctcccattaaattaaggaccagtgggtctctctgaggtcaagacatgagggcctcttctcctgcaccatgggctttctggcagctgtttgaaaaatctcaaaggcttcttttttctttttaaacttattaccagagtccaggctgttctctgagcttcaggataagtggggtattgctaaaaaaaatggttttgctttaattacaggctcttagtaaaactgtttgcctttcatgaacgctatgtattgagcaaaactcctctagtccataatagaaatattttcatatggaaacatggaaacacctttgatcaagaaagatagccttaaactttataaattataagttctgtgaatagaattggccatgttgtgattaaaaagaaatctggggacaagtaataacaaatacatctattagagtcatggtaatatgcctactgtcaactaaaatacatttcttaaaactgaggtctttttggttcattacagcttattactgcttcataataataatgtgcttgaatctcacaaatatgtgaaaattacacagtcataattctcatcaaggactcaatctcaaacttactttttaaaaacaaaatgttggttctaagttggaggttttacttaaggccatacatgattagccttcaaaaatgaaatcaaagtagtccccagatatagaggctaatataaacatattagagcctttttgtgaaagacttggataccattcctaccaaagaagtcagtggacacattaaaagcatttcaaaataaatagaaataagaacattctgggtgggtaaagcgattgctggcaatgttaaaagagaaggataccttcattttgagccacacaaccaacaaaacaaaacactcagaagaaatttaagctttgaaaacttggctgtgatgagaagaagatataaaaagtgaagaatttcccaccttaggtctattccctggatggggctaagggcgttaagtctgcttgtatgatgttggaaacaataatccttatagttctgaaagaaatcactaaatgggagccatccttcgagtttggtcattctgtaaattgctttatttcttatatgtaaaacctgtattcaggaatctgtaaatcttttcccccacctatgaacgtgagctgcttagtgcttttgtcagcaacaaatagtgtatacattattaattcaactttaatgggtccaaagattacatatgctgagcatctaaagtaaaaatataatgcaggttgataggcaggaaaggaaagaggaactcatggaacctcagaagcaaaacctagtttcagaatccagatctgctgaggtctggcatcaacagtcttgtatacatttataggaattaggttggcaggttgatagatttctcattaccaaggttgggtttcttgaactctcaggaaactagaagagaatatttggaaaacaatcatgccagcagcaggccaggagggtgagacttgaaggagatgttggctgagccatttcctgagcagatccgaaggaaatgatttcaattattgtcacacaatgggccagatgctccctcttgccctattctaactattctcccagctccaaaacaaagaggaaaggaaggaggggaaaaaaagaggaaaggaaggggagaggaggaagggaatgaaggagtgaagaaagggagggagggaagaaaggggaaggagggagggaggaaggaaagaaggaaaaaaaggaaagaaagggaaaaagaaaagcattacaattaaagcaagaattaacagctgtaataaatataaaggttacttttgcataaaatgaaaatagaaaaggtcagttcaggaaatgttaacacactggctcagtttctctcagttcataggcctgaatcattaggcgtcgcaggcccaataggaccacagctttgttgcttgagcttttatgaggcatatctgtgctggtggcagctagcagactggcagggctacaaactggcatgccctcaggtcataaactaattatggcacaatcattcacttgttctagccattctgccaattacttcatgagtagggttgggcgggacctttgtctaaggcctgctctggaaacaagacctcctgggcttaagccttccttcctgtggagttctgtgggagtctgtagggccatcaatagtctcagtaggccaaccagtctacccttctgccttaataatccactcaccaattattaagtgtctgtgttgtacaaggcccagtgaggaaatgcaaaaataacaacgtactcttgaagggcttagagtctagggttagggtggggaacataagaaccattcaaaacctctgcttaagcccacttgcatatctcaagccctggactttcctgaacagaagggcccttttgaatctagacactgcattagtcatctgagttcattccacatgttctcggggggaataaaaagaagatgtttacttccagagtcagtgtaagcttccatctttttcccaatgatggtggataagcttccctgttctccagagtcataattcaattaaggtcttaccaaagccttcctgtccaagagaagggtcaatcactcttccagcacagcaactcccctgccccaaggactacccccactgcactcaattgaagtgcctgactaggtacactcagaggagatacatccctttatataaaagagccacagacttacaaatagcctcggggagccagcatgcattccaagaaatacatgtaaacacatgaaaaggtatgtacacaggtttgcttacaaacaaagtcagaagaaaagtaaacagattgggagggggaaatttcacagctcagtgagctgaagacctggatagaaaggtgaatgaataagtccaacatactgtgtttcaaggcagcagcatacatacacagtcagcagtgacaactggtttgctgggacaggaaagaatggatttgcagagagaattcaggaaacagtttgaggatcaataggccccatcagtatgccagtgatttcatactaatgcagtcaaggtcccagagtaaattatttccatgcttattactgcttatggcaaacatcacccaattcagacttagaggttcaaatagccctagctccctgacagacatcattgaaaacattcctgcaaggagcaccctttgtaaggtggagcctggccaagtaccaggcgtctgctcctctccatggtcacatagtctcctgctgccttccaccctcatacaggcccccagtctgtttgcattcccacacctggccccaccttctagcagaggccaagagcatcattcttggatgaatgcccagcctttgaagtcagagagaatgcaggctgttagatgaggagatccagattcaagacttctcaacacacacttccccctactcaacaatgcttacaataaagttacgctcaagaggcactctggctgctagaaaaacaggaagccagaggagtgggtaggtcagttaggctctctagactggcctgaactctgtggaatgtcaggctcactagaaagctgaatgcctccactgaaggtgtgaccaaggtatctttaagctggaactgaccaaccacccctgtcttagtaaaaaggtatttctccccaaatctgccttccccaccctcccttcacacacaaagaaagtagccaggccttcagtcttggttctctagagcgcagcagaacaactcaggcagaagcagcttgggagaccttgtgcttctctattcgagtgctttcctaaactgtgtggttggcaaaaaacagatctgaacatttggctggaagcagccatgtttaaaaacaattgtttaatttcaagattgcaagaacctttcttcattttggcagtttgggagagggagtggaaatgtagatccattagaataaacagtaaccatccatttgtgtgtatctgttcatctaggtgtattcatggaaatctgggagaaattaagccttctgccttcttctagcccataaggtcattggtctgccacgcctcctgcaataacagttgcaatgcaataactcatacttacatagcacttgacagtttacacagcatcctcccattcattatgccatttaataaagattaatccattatgtggtgtgactaattccctttgacctaacaattctgctttttctataaatatctcttagtaaaataatcagataagtgtgcaaaggtgtacgtacacaaatggccactgttgcactgtttatattagcaaaatgttaggagcaaattaaatgtcaattaatatggtactggtgaaaatacctgtagtatttatatagtcataaagtgtaatacagtgataccattaaagtgattctgtagatctgaaaagatttctgcaacgtattgttagttgtaaaaacataggctagaaaacattacatataatatgaccttgttttttatgtgtgtgtgtgtgtgtgtgtgtgtgtgtgtataaacatggaagaatgaagtgtgagatatgcatacacctaaatatcaatgcctgttacctctaggaggtaggaatgtggctaattttaattttcttctttaaacttctgtgtattttctaagttaatattaaatcaacaaacattattgcttttgatgatgtggaaaacaataaagctacggtcattttggaaaggagagaaaacatgtggtaacaacaataatagtagctaacatttactgagcagttactatgtaccttggttttaagtacacttatattttgatctcataacagtacttatgaggtatgtaatactgtccccatattagagatgagaaaacactgaagcttagagagtttaagggacttcccaaggacacacagctagaaagtgacaaaactaggatgtaaactgaggtttctgttgactccaaatctcattctcttatttgatgctctaccaccttcctcttctagggccctttctcccttgaagtgctcaaaacaatgtatcaaagccagttattatacttttgattacttacgccagaaagaccccattaagagcataactgtttctagctcagagcaaggtttcaaggaagcagcactattagagcctgatgccaaaacccaggtgaccaaaatcagcaatagctcaaattgaaccttcatcccttaaatctcacaaatgcaaagacagtctttgtttgattcaaacgttttcttcctccatccatccatccattccttcattgaatacctatcatatgctaggaactgtgggcatacaaagatgaataaggcagactccctgccttcagataatgtgcaatctgatccttagtgcatcacaggcccattcacctgagaggcttacttgagaacaaactccaagttgaaatgtgaccaatgaccaaggggccacagcaggaaacttgggaagacagaaaacaggttgccaaattcttctttactacacttacaaagaatatggaaagtaaacatatagatccaattaaccaaatctagcaaacattattgagcaatgactatgtaccaggctctgtgttaggtgctgtcacatatcttatgagtactactattactactattcatactaccattacgaaaaataacaactaacattttattaaatcctcactggtagtgacagaaaccaggctaagtgctttacatacaatgtaagttttcacgaccacaaacctattaacatggcttaaggttgaggcctacctaatatgaaatcaaaatgaaacaaatcaacaaacaaagcatctagaattctccactgttcccttattcaccatgaggtcatcttagagctagaatggtttgaatattcagacacctacataaatacttcccatttgttcatttctctagttcagctcacaggttaacaaacttagagaattactgtatagacttctatgcacaacagatacagtactgtactgcaatacaaaagatttccaggaagagtttcaacgattcatgatttttgtcttatgtgctaattttagtacatgacttagagaatacatgagataataatgatgctataaatagcatatgaccagtaaattataaatgatgccttaatatactaatctcaacaataatcatatcagagaaatacccattgtacaggtaaggaaacaagttcacagaggtttgtcccccattgcttcagtgtgaaaaagccaaggtttaaactatgtctgactgacactaaagcctatgcttcttgcacagctttatgaaaggcactttctttttggcaaatgaattatgtttgagctaaaagcaatgaccagggtaccatcggtgagatagatcagaggagatgaacatgaaggcagatccaaagaagagtgatgaacagaaaaatgacattatcaaacatgggctttggaaaaattaacctgatgatggtgacaccttttccctgaggcaatgtcatctctcttttgaggttgaatacaggcaagaagggctagcctacaaaataagccacttttgcggtggaggtctccaaggtgctaaggcatccacatgaacatcacttgtccccttgaattcccaaactgaggactttagggctacatttttggagttgataaaggaagctagggcctggttccctttcatcagatgtacaaatgtattggttacagagttcacactgaagaagacactccagcctttctagggtctcagtatggtattaggcaacaacaacactcttgttgacatgtccaaaatgtgctatttttcacttaaaccacctacatctaatctcagaaaaaaacaccttgggacttgagaatacatctcttgaaaagcaaaatgccaaggaccacgaacagttccctctatcccacttaaactaagcttgcagaggtacttctccccaaagggcatgttgtcctgttcaagggagactggggagtttctcaaatacttttgcttacttctcaggatggccaaaaattaaggattataatcctcacccaccaggtggccatttatatccaaaaagatttgaagcaccttacaaaaaaattctgatgtcacagggtcataaaattaaaagaaagatttagaaaaaaaaaaaaaacagaaaatgaggttattttatttaaaaaggaaaccttttgtttacatatatgttcatcgaatgttcaaatttgatctgagcttcccagcagccaagacacaaaggcaaacactataggtttcagaaccttaatctgataaaaggaaacaagctaatttatcaggaggcaaactatttatgagcactggattctacatgcaaactataaaaggaaaaaaactttaaaaacacaaaaactgatatttctgacattattttgccagaatatacttttgtcatataatcattccttaaattgacactcatgtcttgaattaccctccccatgtgaacaatccttttgtttttcctcacttgcttcccagtactcctgatgaagggcctgtgagcaagtggtgccaacaccctcctgatgctgctgctttggatctgttccaagtttctggatacttggttgggacctccaaaatgctgagtttagacagcagataccagtttgggcccagaatatttttagggccatgttagtgtcaactaccttaactagcagcctagcttcttagaaatggctgatattgggctctgggtaggacagtcaatggtatctaaagggctctttccactacagctcatatgcctaatggatcagaggtacaaaaataatcagcacccagcaagcgaggtcagagtcaggctcagtttggatcaaagatcatactcaggagcgaagaatcctaggcatgaatacaaagagggaggtctgggggaagggttaaccagtagacagtccagcttccaggaagagtactggggtaagaattacaggctggaaagaatgtttggcttcgatatggaaagcccttaacgcccacccaagtgaccaagaggtggggcactctgaggcaagcaaagagaaagaaatggcatgctcacaagggcaggtaagggggatgttgaagaaacagagtctgggaagtaaaattctgaatagcctgatgaaaaggacatttttacatactcatgttatgagcccaacatctgacttgggtgacaagtaaaaggggatactgttaagagccaaagtctcacccaggtgtgacatatgagggaactggtgcttaaccaaagctagagaagcagtggaaggtgtggtatggcaaaagccaggaggaaattccagtaagaaaagaatttgcactcaaccgtaagccaaatactggcatcatttcatttaattctccttacaacaatcctgggacttaagtatgattgccgttatgacatgtgaggaaactgagatacagggagttgcttccctgaaattgctgaggggcaactgactaggaaagagcacttccagcctttgagccagatgtctgtggctccaaatcttgtagtcttccaattcaatggctgctaaacagagccagccctatgtaactaagaaaccaggcccccaacactggggcgaggggcagcagcacctttcccctggcagcctagtaccagagaaaagctgctttcctgaagtagggccaatcaaaattggctttctaggctttgttaaaatcctacctattgtgttatttctaaatataacatatatacacattttatacatatatatacgtatattttaaccttttatttagacaatatctaataataataatacaaggtagtattgagcattactgtgtgccagacacagcaccaaatgcttagtggcttagatcatctattcacatcagaaaatctacatataaataacactatctgcaattcacagatgaagaatgagggtgaataacttgcacagggtcgcatggaaaataaatgacagaatttccatttaactctgtctgcctccagatccatgctacactgccttcctacctctttgatatagataccacaaaaatataaattagcagaaagaagaaaacaaaagcatccacaatatcatttacatatctgctattctctaaagactttttttctttttttttatttttttttgagacagggtctggctctgtcacccagactggagtgcagtggcatgatcatggctcactgcagcctcaacctcctgggctcaagccatcctcccaccccaagctcccaagcagctgagactacaggtgcacaccaccacacctggctaatttttgaattttttcgtagtgacggggtttactatattgcccaggctgtctcaaactcctgggctcaattgatcctcctgcctcggcctcccaaagtgctaggattacaggtgtgagccaccgcaccggcctctctatagactttcaagctacataaactagtgttttgatttgacctgttccttcataatcccacagctctttccccaaagagctgataaggcaagaactaggcatttatttagtttcccctcactgttttaccccaatgggtagtcacacctgttgctgatggaccagaatgaggagacccaagatcagtgatgacactagaatgcaggagaattttccaagacattacttcctgagcccgggagcccagtgggagttcactgtataatctgggacaatgagatgcttaggtaatcacctcaagctggagactgacatgatcctttatcaagcattaaatcagatggctgtaaatagataagaagactttttaaagagttggtaagtttttaagtaaattatcagatgtttaaatgaggatgtatatacaaagatgttttctacaatgttatttataatagcaaaaaatgaaaacctaaatgggcaattacatggagctaataaattaaactataatgcattcatatcatgggttattattatgcagtaatttaaaattaaattttcaaaacaatcataatgacaagggaaaagaaccataataaattaagtggaagaactggagggaaggatacagacaatatgaccaggagtgtgatctcaaatatatattacttttataatcaaaatatattactctgttaatgaaaaaaagtcaattttataaaaaccaagattaataattctgaccctttccacagtgtttttgctcttacaattaggttcgctttttctcataaatggttgaagttgctgctttcatttgtaaaatgggtgtgaaagtaattactaatctcccacagtttctgtgttgatgaaataagatgatggatgtggaagtgatttctttttcaaacattagagtgctagtcacttctgagctatattgctgaggaaatcctacatgtgctgatttttttggtgttctgtagtaatcaatctttcttaaagccagggcttcctgcccatttctactgccatcatcacacttcaggcctttaccctcccattgcctgaacttccataccagtcttccagctggacataccccagtcttctggtctcctctatccaccctccacaatgtatcaagaatcagctttctgaccatgttaatcctttgctcagactactgcagactcttgagtacccttcacatatcacactaattttttagccaattattctatgacattcttcaattatcacccaagttcccatataatcagctaaaagtgttcaacatgttttgcttaactagaaagcactgcattacgtagtagaccctcattgcaagttatctattggtaagtggcaatgtggcaccttcctactcgaagtgtgatctctggaccagtatcatcagactcacctgggagtttcttagacagacattatctctgactccacccagacctactgaatcaaagagtgttccctaggtgatttgtatacacagtaatatttgagaaacactagtctagaaggccctaaagttggcagatggagcaaagtgttcacagctttttcacagatttattgactcattccaaactgtccttgtgtctttcacatatgtttattcatcccctttcttagatgtaagatcattaaaaagtattaacttaaatcttcctcttcctttgtctcaacttctaccatccatgccctcaataagtgctcatcaagtaaaaatagttttaaagaccatatttaaaagtaaccataaaacttatttattatagcatagtggttttaataaagggaatctggagcttgccagcctgagatcaagaatcactttccgacacttcccagctacatgaccttaggcacattacttggcctatatgtgcctcaattgcctcatccgtgaaatgaagatactaataatatccacatcaaggttgttgtaagagttaaatgagtagagagatgggaaactcttagaacagcatctggccgagttaccactgtataagttttaggtattaaatgtttttagaaggtaattataataagtatttcaaaacttaggccactaataatcataaatatagaattgttccatgacagactgcgtgcctgaaatttaagtctctggtgtctgcatactcttattgaattctcacaactcctcagcaagattaatggtaatcttattttacagaaggcaaagtttacacagcttgacttgacttcaggtctgagggatttcagagtccatgttccttataagaagagggctttatagacaacagagaaaagaaacagttgattcgaagatgtaatatagaatgaggtaaaagttgatggtttgactattttgggtgcccagatttcagaaaagaaggattagcattgtaagaactcacaagcttagtgatacaaataattaaaatagtactgtggatattgcattcagtgacttaaacatgaagtgaacagtttgtaaagagcaagccaaggataatcatctgggtctctgggattttctccatcaggatttcaggccaataaatggttaatggaaacctgtctacatccccagctacatagactgcccctgtacaggaagtatgtacagatattcctaagctagaatcagggaatctggaacatgcaggaagaagaagagagtctcgcaatgtgcctccaacactcctctcctggacattgctatctctggttcttccttcctgccctgggaattcacccagtcaccatctgcaaaacacacactgctgttaagagaagtcagagggggataatgcttgggattagggccagagctaggaaaatagtcctcttcctggaaggacattcctggaaggggaatgtggggagtggtggcctttgggattcttccaaattcatagcaagcggtggcagcatctagtggagagaataggcccaggggccagaggcacagctgaagctcccagcatggtgtttggcgtatcagtgagaacctctttgtgtggctgttaggtaataaatcccttgggtaaaaaagtatgcaaaagagtcttgagtcagtcagtcccatttattacaagaaaggaagagaaatagacactgaattatctatgcatacagatgagatattttagccacctaaattaataagataatttttaaaagccaactaagtagtaggcagagttcatggcatctagaatcaacaatatggtataccaagcaaagggtaagaaagtagggaaaaaggaaaattgcattgcaacctcaaaggatgctgcagctgaaaatgagtcagtgatggcagtgataagatacaattggaaaattcaaatttaaggagttggagaaacaaaggtgagttctatctgaaaaggaaatcatgaaaagtgctattaatgaaatcacatggcatgtaaacagtgcataaagtcccgaggctgagggagtaaatgagaacctaagctccacctgccaagtctcatgcctcaaaacagggctgaatccacctgcagaaaagacagtctttctgtaattggcacaaaagcactatatgggttagtagcaaccctgtagtctatgtcttcaggggatttcatattgataaaaactaggactgtagagacaaacattaaacttttggccccaaatagatccagatatttcatctttcatttctaactcactcgatctcttttcaagtatttatagctggatataagagtttcacttgataacctaaaatccaaaactcccaacagagttatggtctttggttaatcagagttttccagagaaacagaactaaaaggatataaagataaatataggaagggagatattatgagggattggctcactgattatagaggctaaaaagttccatcatatgccctctgtaagctggggggaaagccagtgttgtggttccagtccaagccaaaggactgagaactaggacagccaaaggtgtaagtcccagtctgagtctgaaggcctgagaagtaaaagcaccaatggtccaagggcaggagaagatggatgcccagctaaagaagagagagagagaatttgcccttcctctgccttatttttttcctatttggatgggacccctacagatcccatgatgattgcccatattggtgagggtgatcttctttattcagtctactgattcaaatgctagtctcttccagaaacaccctcacagacacacccagaaataatgtcttaccagctatctgggcatcccttagcccagtcaagttgacacaaaattaaacatcataaccaccatccaacataatttgttaagctccatattacactcacgaagggaaaacaaatgttggaaccagaagttttaaggctgaaagggtccacaggacacttccagggaggcttttgtctgaccctgactacttacgcatatatgctgagaccaagaggcctcccagctattccagatacagactcagaggcttagcagggacaattataagataattaatgccattttttttaaggatggggagtgggggggatgcagattctgtctctaggaatatgggctccaagctatcagctccgaacaaggaaagagatatgaaagtcactgtagactgtttcctgaacacaccagcccaaattgctatttcagccaaaacaattatcggtctagttagatcagaaacagaaagaaaaaaaaataaagacagaaaatactctcttccctcactccctcacctcatcctgcccctaaattccctcttcatggtttgctctcacctgggatattgtgtacaggtctggttaccacatctcagggacaatagcatcaagctggagatcttcatatgaaaggcttaaaaatggtcaatttaaaacaaataaaatgggccgagcgtagcggctcatacctgtaatcccagcactttgggaggccaaggcgggcagatcacttgaggtcaggagttcgagaccagcctggccaacatggtgaaaccccatctttactaaaaatacaaaaattagcctggtgtggtggcacttgcctgtaatcctagctacttggaaggctaagttgggagaatagcttgaacttggaggcagaggttgtagtgagctgagatcacgccactgcactccagcctgggtgacagagtgagaatacatctcaaaaaaaaaaaatctaataaaattaagtccaactgtatacaattagtaaacagaaagcacatcactcccatggtttaaaacagcttgactatataaaccattttttttaaggtttggataaattagctgatgagagacactaaaaaggaaattaatgtcaggaggacaaccattacttatggatgttgactttgtgaaataggaggagggcccaaaagagaaacatataggggctataattctgccaggtcctgtactagaaacattatccacattatctcatttaatcctcacaataaccctctgagtatgtactgttacaatctccatattattgataaggaaactcaggtttaagagaagttacatagtgaaaacaatgtaaatatcctacaatagatgaatgagtggaaaacaaaaagtgatgtatacatacaatcgatacacacaatgggatagtattcacccttaaaaaggaaggaaatcttgcaatatgcaacaatgtggatgaatcttaagtaaattatgctaagtgaaataagtcagtcacagaaggacaaatactacatgattctacttatatggaatatctaaaatagtcaaactcatggaagcaaagaatagaatggtgactgtcaggggctgggaagaaggggaaatggggagttgctaatcaacaggaataaaatttcagttatgcaagatgaatgagttctagagttctgctgttcaacattgtgcccataaataacaatactatattgtacatttaaaaatctgttaagtgaatagatctcacattaaatgttcttaccacaataaggactaataaaataataaaataaaatgagaagttatataacatccaagtcacgtacagctggttaaaatgaggtttggatacagattgcaaaggaagtgaaatcatctttatttgtagatgatatgatcaggcaggcagaaaattttaaggaatctagaaaaagtttactagaactaataagtgagattggtaaggttgcaggacataaaactaatgtatataaatcaaacatatttctacatagtagcagtcaaccatcagaaggtgaaattttaaaatataaaccatttctaataacatcaaaaatatgaaagtacttagagataaatttggcaaaagatgtacatgacctagagtgaaactacaaaacatggctgagataaaccaaataagatttaaataaatggagagatatacattgttcctagattagaaaaatcagtactgctcaggcattaattctcctccaaactgatctataaatacagcacaaacccaatcataatgccagcagccattttaaatagaaattgacaagtcgattctaatttttttttttttttaagacagagtcttgctctgtcacccagcctggagtgcagtggcgtgatctcagctcactgcaacctccacctcccaggttcaagtgattctcctgcctcagcctcccaagtagctgggactacaggcatgtaccaccatgcacagccaatttttgtatttttagtagagatggggttttgccatgttggccagtctggtcttgaactcctgacctcaggtgatccacccgcctcagccacccaaagtgctgggattacaggtgtgagacaccgtgcccggccagattctaaactttatataaaaattcaaacaaggaatagccaaaacacctttaaaaagaacaaagttggaggacttatacgacttgatttcaaaacatattataaagctacagtaatcaagacagtgtggttttggcataaagataaacatatgggttaatgttacacaacggcgtcgccaaaaatagatccatatgtaaaaggtcaattgatttttgacaaaggtaccaaagcaattaagtagaaaaaggataatctttgtgttttgttttgtttagagatggggtctctctctgttgcccagactgaggtgtagtggtgtgattctagctcactgcagccttaaagtcctaagctcaagctatcctctcatctcagcctcctgcatagcaggactacaggtaggcactactacacccagctaatttttaaaaagtggttttattttgtttttgtttttgtttttttgtagagatggggtcttgctatgttgcataggctagtctcaaactcctggcctcaagcaatcctcctgcctcagcctcccaaagtgctgggaatacaggtgtcagtcaatgcacctggcctggaaaaggataatcttttaatcaaatagtgctggaacaattggatgttcatatgcaacaaatagtgttggaataactagacgtccatatgcaaaaacaaacaaaacccaaaaatcccttagctcttacttcacaaaacatacattaacccaaaatggatcctaaacccaagtgcaagagctaaagttatataacttctagaagaaaatataaaagaaaaatcatagttacatcggttaaggcaaaaatttcttaaataggacacaaatgcagaaattataaaagaaaaaatcattaaactggactttatgaaaattcaaaattaaaacattttacttttcaaaagtcactattaagaaatggaaaggcaagccacagactgggagaaaatattggcaaatctcatatccaacaaaggacttatatcttgaataaaaaataactcttacaactcaatattagtattacaagcaataaaaatgtacaaaagatttaaatagacacttcactaaagatgatatacatatggcaaatacacagatgaaaagatgctcaacatcattagccattagaaaaatatacattaaaactacaaagaaattccaatacatatctattagactggctaaattaaaaaaataaaacttaccataataagtgttggtgagaatgtggaggaatggaaccctcctacagtattgacttaagatgtttacaatcacttgagaaaatgatttgacagctttaaaaaatgataatgatatacctaccatatgacccagccattctactcatagatttaaccatgatgagccattctattcatagatttaacaaagaaaaatgaaagtatatgttcacacagacttatatgtgactgttcatagcagctttattcataatagctatgaataactattcataatagctatgaaaaactattcataatagccagaaataatgcaaatgttcaccaggtgaatgaataaacaaactatgatatatctatgcaattgaatattactcagcaatattaaagaacaaactgctgatatatgcaacaacatagacagatataagtataattatgctgagtaaaagaaggcaaagaaaaatacacactgtataattcgattggcataaaattctagaaaatgcaagctactgtagtgatagaaagcacatcaatggttgcctgggggttgtggagctggattacaaaggggcacaaggaaacttttgggtgtgatgaacatgcttattatcttaattatggtaatagtttcacacacatttcaaaactcatcaatttatatacgtatttatacatgtatatccatgtatatcttattgtacatcaaatatatctcaataaaatgtaaaattaagtcaatttgcctgaatatcatagtgaatatattaataaaataagactaattttccaaacaaataaaaatcagtatcctgagtgacatcagcaagatggaatagaaaaccctcaactctcctaaccacatgaacaaacaaattcaacaacaaaatatagacaaattccctttttgaaaaatccagaaactacataagagactcctgtacgatgagactaccacattaaagccagcagggaaatctgagagaccctgtcagcataataacttccccctgtacagagccatacaattgggaagaccccctcaccagattccaaattctccctaggaagggaaggagttagaccacatgtccagtgccccaacttttccaggagctgtccagaagattggcttcagttttgcctgtctcagagtgatgatgggacctagcacctagccaccttggaaccagagatgagagacagtatgttaggctagcagttgctataacccctcttcccagcttagcacagagccagcagatgaaaatccctagctcctatcttctctctggtgaggaaaggagttggaccacgtgtcccgtgctccaaccttttttgtgggggatgcacaaaggactggtttatgtcttgtttgtattgaagtactgacaggacccagcacactctgtttcaggaccagtgtgatcagagatggcggtttggccttgcagttaccctgctaagaacaaagaaagtagggtggaatagcataaagctttaaaaggccccctaaatctctagctggcctgactgatgagggtcttctcctgtataaggctaggccatgaagactgggataggtagccatttatttaatgaacagatactcacacaaagagccaagggacatgaagaaacagggaaatatatcccaaacaaagggacaaaataaatgtcctggtatcataaattggagatatatgatttacctgacagccaaaactaacataaagatgttcaaggaggtcagaagaacaacacatgaacaaagtaaaaatttcaaaaaagagatataaaatatatatattaaaaattcaggctgggcatggtggctcatgcctgtaatcccagcactttgggaggctgaggcaggaggattgcttgaggctaggagtttgagaccagcctcggcaacatagtaagaccttgtctctacagaaaaaatttaaaaagttagccttgcgtggtggcactcgcctgtagtcccagctacatgggaggctgagatgggagatcacgtgagcccaggattttgagtcaacagtgagctatgattttgccactgcacaccagtttgggcaacagagcaagaccatgtctcaaaaaagaaaaaaaaaaaaacagaaatcttggagctgaagaatataataactgaaccaaaaaattcactagaggggttcaacatgagactcaagcaaaagaaaggatcagcaaagttgaagacaagtcgttggtaattatacagtcagaggaggaaaagaattacagagagtgaagaaagctaaagggacttaaaggccatgatcaagtagaccaatatatgcattatggaagttccagaaggagagtaaaaagagaaagagttccaaaaagcttattcaaataaatagttgcaaaatactttgcaaatctaggaaaggaaatgaacatccagatccatcaggctcaatagatggcaaataagataaactcaaagaaatccatactaagacacattataatcaaattgtccataggcaaagatgaaaagagaagtttgaaagtagcaaaagaaaaataacctgtcatataaaagaaacctccaaaagactatcagtggatttctcagctgaaaccttgcagaccagaagatgatatattcaaagcgctaaaagaaaaaaaaaaaacccaccagcaactaagaatactatacctgtcaaaactatccttcaaaaagatgaagagattaagcttttgccagaccaaacagacaaacaaaaaaacccgagagagttcatcaccaccagacttgccttacaagaaatgataaagagttaaagggagttctttgtgttgaaatgaaagaacataaaataataatacaaaaaatacagacaagtgtgaaattcactggcaaagttaaatatataaacaaatacagaatgatgtaatgctgtgatagtggtaggtaaaacatttttaattctagtataaaatttaaaaggcaaaagtgttagactgtaaatataaaatatgttaatgttaatgataaaaataaaacgataggtaaattgtgacattaatagcataaagtgtgtgaaggggaaactgtagtttttgtatgtgatcgaagttaggttgttaatcagcttaaaatagcctacaataactataagatattttaatgtaaactcttctaactacaaagaacatacctattgaaaatatacacaaaagaaaaagagaaatcactcaatacagaaatcaaaacacaaaagaagacattacaaaacaagaaaaaagaattataagacagacgagaccacggtgaaaccccgtctctactaaaaaatacaaaaaattagccgggcgtggtggcgggcgcctgtagccccagctactcggagaggctgaggcaggagaatggcatgaacccgggaggcggagcttgcagtgagccgaggtcgagccactgcactccagcttgggtgacaaagcgagactccgtctcaaaaaaaaaaaaaaaaaattataagacagaaaataataagcaaaattggcaatactaagttcttctctattaataactactttaaatataaatgggttgactcccaaattgagagatatagagtgagtgaatggatcaaaaaacaagatccaactatatgctgtctataagagattcacttaagttttaaggacacacaggctgaaagtaaaggaatggacaaagacattccatacaaatgctaaccaaaaaacagcaaggtggctacacttatatcagacaaaataggccaaaaactgtcacaagagacaaaggacaatgtgcaatgaaaaaaggccaattcacaggatgatataagaattgtgaatatatatgtacacaacattaaaccaccgaaatatataaagcaaacattgacagaactaaagggagaaatagatagcaatactataatagtaggagacttcaatattctactttcaatagtggatggaacatccagacagatgatcaaaaggaaacagtgaacttgaacaacactatagatcaaatggacctaacagaaacatagaacattccacccaaagcaacaaaatatacattcttttcaagtacacacagaacattctccagaatagatcacatgctaggtcacaaaacaaactgaagaagattgaaatcataccatgtatattttctgaccacaatggaatgaaactagaaatcaatatcagaaaaaaaactggcaaattcaaaaatatgtggaaattaaacaatacactcctaaataaccaatgggtgaaacaaaaaaatcaaaagggaaattagaaaatattttgagataaatgaaaaacaaaatagaatgtacaaaaccgatggaatgcagcaaaatcagtaccaagaggaaaattatagtgacaaatgcctacattaaaaaagaaaaatctcaaataacccaactttacacctcaagaaactagaaaaataaggaaaaaaagctaatcccaaagttacttgaaggaaagaaataataaagattagaacataaataaacaatacagaatagaaaaataatagaaaagatcaacaaaatgaagtgttaattttttgaaaagatcaacaaaattgacaaacctttggctaggccaaggaaaaagagaaagatacaaataaattaaatcatcaatgaaagagaagacattacaactgataccacaattacaatcatgcatcacctaacgacaggattatgttctgaaaaatgtgtcataaggtgatttcatcactgtgtgacatcacagagtgtacttacacaaacctagatggtatagcctattacacctaggctatatgatagagcctattgctcctagtctacaaacctatacagtatcttactgtattgaatattttatgcaattataccacaatggtaagcatttgtgaatctaaatatagctaaacatagaaaaagtatagtaaaaatatggtattacaatcttatgggaccactgtcacataagtggtctgtcattgattgaaacatcattatgagatgcatgactgtatatgccaacaaactggaaaacttagaagaaatggataaatttttagaaacatatgactgaccaagactgtcacaaagaaatagaaaaaaatctgaacagacctgtaactagtaaggagactgaattagtaaattaaaaatctcccaataaagaaaaacccaggaacagattactttactggtgaattttatcaaatatttgaaaaagaattaatgccaatccttctcaaacgctcccaaaaattgaagagaagggaacatttccaaactcattttatgaggccagcattatacctgatacagataaggacactacaaaaaaagaaaactaaaggccaatatccccaatgaaaactgatgcgaaaatcctcaacaaaataccagaaaactgaattcaatggcacaggaaaaggatgatactctgtgaccaagtgggatttatgtctggtatgcaaagatggtttaacatatgcagatcaataaatgtgatacaacatattagcagaataagggataaaaagcacatgatcattttgagatacaaaaaaagcatttgacaaattcaacagcctttcataaaaagctctcaacaaactagaaatagaatgaaattacctcaacaaaataaaggccatataagaaaaccccacagctaatgtcatactcaatggtgaaaagctgagtttttcctctaagatcaggaacaaggcaaaaatgcccactcttgccacttctgttcaacatagtgctggaattcttacccagcataattaggcaagaaaaaataagtaaaggcatcaaaataagaaagaaacaagtaaaattattttttacttaccaggtaacatgatcttgtatgttgtcagataacatgatcttatacggagaaaatcctagacactccataaaaaaactgttagaactaataaatccagtaaagttacaggatacaaaatcaacatgcaaaaatcaacagtgtttctatacactaacaatgtactacctcaaaaaaataagaaaacaatcccatttactatagcacctaaaataataaaatacttaggaataaatgtaactaagaaggcaaaagacttgtatactgaaaactataaaacattgatgaaagaaatcaaagacacaaataaataagacattcatgctaatgaatgcaagacttattgttaaaatgtccatactacccaaagtgatctagaatcaatgtaatccctatcaaaatcttaatggcattttttttttgagacagggtctcactcttttacccagactggagtacagtagcatgatcaaggctcactgcagccttgattgcccaggctcaagtaatcctcccacctcagcctcctgagtagctgggactacaggcatgtgctaccatgcctgactttttttttttttttttttttttttttgtagaaacaaggtctcactatgttgtccaggctggtcttggaatcctaggttcaagcaatcctcttgcctcaatctccaaaagtgctgggaccctagtggcattttttacagaaataggaaaaaaaaatctctacaattcagagggaattgcaaagaacttcaaatagccaaaacaatcttataaaagaaaaagctggattccctgatttcaattgatattgcaaagttatagtaatcaacagtatgtacatatagagcaagggcacagaagagacagccccaaaataaacccacccatatacgaccaagtgatctttgagaagggtatcaagactacaaaatggggaaagtatagtctcttcaatgaatggtatgggaaaactggatatcaaaccactttcttacaccatatgcatacacataagacctgaaactgcaaaacttgtagaagaaaatgtgagggaaaaggctcttgacattagtcttggccatgggttcttgaatatgatactaaaagcacaggcaacaaaagcaaaaataaacaagtgggacaacatcaaactaaaaggcttctgcacaactaacgaatcttttaacacagtgaaaaggtaggctgggcatggtggctcacgcctgtaattccagcactttgggaggccgaggctggtggatcacccgaggtcaggagttcgagaccagtctggccaacatggtgaaaccccatctctactaaaaatacaaaaaaagaaaattagccaagtgtggtggtgaacacctgtaatcccagctatttgggaggctgaggcaggagaatcgcttgaacccgggcagcagaggttacagtgagctgagatcatgccactgcactccagtctgggtgacagagcaagactctctctcaggaaaaaaaaaaaagaaaaggcagcctatggaatggaagaaaatatttgcaaagcatttatctgataaagggttaatatccaaaacatataaggaacttatacaactcaacagcataataacaaaatccagttaaaaatgggcaaaggacttgagtaaacatttctccaaataagacacataaacagccaacaggaccatgaaaagatgctcaacatcactaatcattaaggaaatgcaagtcaaaaccacaatgagatatcacctgacacctattaggatggccattttttttgagaaaagataagtgttggatacggagaaactggaacacttgtacaccatgggtaggaatgtaaaatggtgccactgctatggaaaacagtatggaggttcctcaaaaaattaatactagaactacatactagatccagcattcccatttctgggtattcatctaaaagaaatcaggatcttgaaaacatatttaaaaccccatgttcattggagcattgtttataataaccaagatgtagaatcaacctaaatgtccatggatgaaagaataaagaaaatgtggcataagacacaatgaaatatcattccagaggaaatcttccaatatgcaacaacatagataagtctggaggacattatgctaaatgaaataagctggtcacagaaggacaaatattgcataattttgcttatatgacgtacctaaaatagccaaactcagaagcagagagtagaatgttggttgccaggagccagggggagagggaaatggggagttgctattcaaggggtataaagtttcagtaatacaagatgaagatgttctacaaatctgctgtacaacattgtgcctatggttaacagtgtggtattgtgaacttaaaatcctgttaaaattgtagctctcatgttaaatgttctcactacaataaaaagtaagttagatgaatgtaaaattttaacaagacatatgaatatactttctgacatcgaaaatacaaaagtaaagactggagaaaaaaatcagtatcattgctttttagtcaaattttatctagtaggcacaacccattttggaagaggagactatctaatgactcccagacccttctaatcctgaagattttagtaaaaacaataaagggtcatgaatgctgcacgctaatgtatattgcagtaactagtatcacccttctggagaacagatttcaggtgatatctaaaagaaaagaaaaaagaggggttactaactttggcttttttgaatgatgaaattaaagcagggctacctggccttaagtctttcaatagttaaaaactaatcttggggctttttaattcatttaagaagtcataaccattatacaagaaagtagaaggaaaaaaaaagatgtgtggttcccatatggttcagtaataatcacaaccagtctatgacttccttaaagagtctgatgaaatatgtgaagggagaaaaaaaggggccctgtgaaagttgtatgggttggggtgggggttgatgaagatattatggggccagagagagaaatcaagagcacattttgtactttacaaaaccaagttagacaccctgaggtaggtggcttatacttatgtaaaataccagccagtgcatcaacataaatttgtaaagtaaccactaatgatttatagtcaatgcttagtgaactagaacactgcaactggagctatttaactttttttaacttctgaaatataattaaattggtacacattgaattaacagtaccgtgatccttcagagaatgatgtgttacccgctgaattagcctgtctgggtagtaaatcatgttgttgtctaacatgctagatgagcatatctcactcgaacagagagcttggcaaattttagacagaactcatttacaaaatacacatgggaaactacaatcactatgaaattaagagaagaaatagaagagaaggaggaggttgggggagggatgttctgcaggacgcagcattttaaagagactttcttagcacagaagacaaggaagctttgcactcaaaaaactgtccctccaactacccaaccaccctccatcattctctctctgacacacacaaacacacacacatacacacacacacacacacacactaaaattcacagtctctagattcacaatctctagattgtgtggtgaggtacctacctacctatttatctacctagcatagtaatacatgttaaggacaaggaagagaggagatcagaagttataaatattaaggaagtcagatcacagataagggatgtaatgaaatttctttttaatattgttcctcatttggctcccagtatatatatgtatgaatatgtgtataaatgtgtatatatatatatatatatgtgtatgtgtctataaatatatataaatataggtgtgtgcatatatatatatctcatacatgatatatgttggataacaacatctttatatatatctttatatatatcatatatatctcatatatatatgatatatatatgatatatatatatgatatatatatatgatatatatatatgatatatatatatgatatatatatatgatatatatatatatatatgatatatatatatatatatatgatatatatatatataaaaccatggataacaacacttgttttctggccctgagagtacctgggaacaaatgtgcaaaactattgggcaataaacagaaatgaattaatagcctaagaaagaaagaatttagagccagatttagaaagaggagattcatacaaactcaaaaagaagaaatctcaagtctttcagaagttcctaaagcctagctctacttgttaaatgctctatggaacagatttggggttaaaagcctaatccagcagtttatgtctgtgggccctgccctcaaggagcatatcccatgaagtatataaaacaagcatgcccagctcattagaaagaacatggtgagcaccagatggaagatggggtagaatgggaccagaaggaagggtaatttctgatgggcttcaaggaacaggtaagatttagtcaggtagctgggactagaaatgcattttaagaaaccatgataacaagtcactgggcatattcagaaaattattgtcacatttgaggctgactgtgtatggcagtgattatgggtatgtgctctggagatagcctttctgggttaaaatcctagctctaccatttactaactgtgagactctgggtaaaccatttggatttccatatgcctcattttctttctctataaaatggggaagaataatagaaacatatatagttgccatgtggattaaataatacatgtaaaatcacttagaacagtggcatccaataagtgctgaataaatattagctattttttaaaatgtggatgaagtgcaaaggaagtatccatgatttcagcctacaggggaagataggagccatatttctggagaacttcggatgccagacctgaggggtttgaacttaaatcaagatgaagcaagtttttaataatagagtatcataaaggcagatcagttggtgtcagtttgtggtaggagatatagaacaactcttgctatctgacaatacaaagggctggcttatgagataatgttctccatcaatggaagcattcaaaagaacagtctgaccaaccaaattcaagggtgttattaatggcactcaggcagcaggttagtgttggtcagcttggatggcctgcctctaagattcctttcaactgtaagttaatttaggataaagactctaggaccaatatggaagaaagattttttcaaggcactgctgggagcatggagccatagcaacaattcaagtgaaagagaacagtacagagagtggaaatggtgggaggtggggagacactgggaagatttctggtctagaatgttagaggtggaaaggatggagttctggtctagaatgtcggaggtggaaggaatggtagggctaggattttaacccacctctgagatgaaccagtcagtccagcttcctcattgtatagaaagggaaactaaaattcttggatagaagaagtgtcttataagataaatttaacaggagtgatcttagaagcagggaagccagccaggaatccagaaaccagacataaagtaataagagcttggaagagggtaggagtagcaggaattgaaaagaagcaggtggatatgagggctattgtaaaggaagcaagactgacagaatgtgggatatgggatgagtaagcaatgactccatgattttaatgctagctgagtggggaagccaaggaaagagcccattttacaaggggaagataagttccattttagacatactggggtatgaggtaaaaaagaaatattccagtgaatactatcagacagtggaaaagattaagactagagattcaggagttatgagatctcatcgttgctttcttgaggaaaagaggagagggggaaaggatggggggagggagaatagggaaagaagaaacagagaaaagagtgcggggggagggactgagtgctgagccttgaggaatatccacaggatagagataagagaggcagtcgatttacagaggagaatggagaaacagcaagagaagatgcagaaacaggagagttcagtattacaggagctatactggcagcagagtttggagaaggtcgagtctgaatggtttggaaacaatgccaatgactagcaatactaagaactgtttaaataattaaatacaatgtggctgttaaaaaatagagataaccttctgtatgcttgatagggaaagatctctaggatatgtaagtgaaaaaagcgaagtgcaaaagattgttttagtatgctaccttttgtataaaaggcaaaataaagaatctatattgacatttgcttgtgtatgtatagagaggctctgaaaagacacacagaaatatctaagcacagtgggaggtagtggtgaaactggacagatgagagacaaggatgactgggaaactattctccgccttttcatactaactaccttttaaaccacataactacattacctattcaacaaattattgaaaaacaataattgtatagagaaaacaaggatgatgaaaacagtgagaaggccagtatatttggccctcaggaagacctcattggaagccagattggagaggattcaggaagacaggcagtgaggaaacagagacactgagcatgcacgtatatgagcatatacaacatgcctacatataatgtatctttggaagggtgtctttggaagagtacacaaggaattggtaacagtgattgccactgggaagggaaattaggtggtttagggacatgaatgaagaaagatgtacccatttatatagttttaaaaattttgttccatgaacatttatcatctatccccaaaataaacatttaaataaataaattgtgctagaagagaaggaaggaggggagagggagagagggaggccacccctcacttaaaaaaaatttattgacagagagggcagtaagaagggtaggtttgtaggggccgagagggtcaagtctggttttttgtttattgcttactccccttctagtttgggaggcaacaagagcatgggaaagaacaggcactctaaaatcagataaactggattttgaataccagccctgccagttactggtccaatgaattctggaaagttacttccctcttagcctcaatttctgcatcttggaatagggacactactaagtacctcttcgtgcattatattatttcatcctcagagtctaatctgtgttttttaacaagcttcccagcaaagttgtaaactgactgatctgtgaaacccacgttttccaatgctatgaaacacagaatatagtcatcatagttaacagtggtattaaaaagacaatatgaaacacagaaaggggctttggggctgaagtaaaattttaaggtatagtaggacaagcataggatttggggtcaggtagagttgagttcaaatcacagctctaccacttactggcttggttacttggagaacattactttgcccctctgaacctcattattttcatctgtaaaataggaatactactacttaatttacagtaagtagagatgagaagattagagagtatgcatataaaattcccagaacaaaatatgcatctaattaatggtaactctgacgatcaccagcccggagttagggttcccaagcacataaaaacagcaatgccaattttctactgtgcatttccattcccttgaccctccgaaccaggcctgaaaacataaaagcacacgagctatccctttgatttttcaagcacctatgaggtcacccaaagaattccctcctgccctttgaacctttaactcattctcaaatgatttactggctgcctggcctccaaatgaccatgctagcagccatgtccttcctatctgaggctctgtccctttgataacaacagtgcctctgatggggtttaccattcccacactctatgagcctgcttctaagacaaaattttcaatcttggaaggacttaatacaaacaacagtaaggaggaagctaacattctctgcttctctcaccaatgcctgcaaaggctggatcatctcctctctaaggctttctcagtttgtttgtactcctttcatacttattgtgattgtgctaaggccctttcgaggcctgttcctaaagtcattccagtgggtgaactctccaacagtatcctggacaggaacaaactaagagaagccctatagtgtgtcttttaaactgtcacagtactactactgtgaatttcaacctgttccctttagtgcccttacataacctaattgactgccacagagacagttaaccaccaatgagattagaccccatttggaaggaagacagagtgagttccctttggcccttctcagcattctcagctttgagtaaaatagggagaatagcaatatcatggtcaaataataaggacacttaagacactgggtataaataccagacagtgactcacatccaaggccagtcagacacaacatgtcagagcttgcttaagaaaaagtgaaaacacatgcatatacattcacacatacacacacagagtgtgttcacccaaagctactgcctctcagctaaagcagtgaaacacttgagtttcactgaagacacacactacacccaccttaaacacatagcaacaagtgggatggctgttgttttaagagtctcacagcaacgcgtcccaacaccataggaaatgctgcaatcatcagccagccggcctctcccacatgcaaacctcggaacacagcttacacacaggaactccagcagcagcatgaaattcaactgttataaaccaaacttcaggcagcctggggacaagcaggtagccaaccccatcctctactgctccttctcatcctgggttgcctctgggatccttctcaacttctgtccccaacattattttcttctaagtgttccctctgcctctagttcccatgtgtgtgtcattcaaggctcaccccacttaggtggggtgtcacacaaagtttgggaaacttggccagtatatccagatcatctagtcatattctctaatttaggcttggaagtggaaaggggaaagattaccaatcacggagtaaaaaatttttgcttgactcttcttacatattatctaaaccagcaaaccatgatggagagtctactctgtgctgactatggaaaatatatagaagatacagccattgtcgtctagaagatcttgatccagcaaaccaaacacaagacagccaaagtacccaaagacagctactggaaaatcagaactccggcatttcagaggggaggttctgattgcttccaccaggagcaatcaaagatgatgccctagaggcttagaggtagggcttgaaggttaggtcctatggagagggccagagaagtgagaagtccttccaaggatgcagtgtgaagtctagccactggaaagaacatcatggtgagaaaatcggaggccagaatttcccaggtgggtttggggaacagagaggtaaccgttctgcctgaaaacctggggcctggaaggattgctaagactggagccagatggagaatggtctgtaataccaggcaaaagtagtttgggctctattctacaggcagcagggaaccattaaataattttaagggagggaggaggggatgatcaaagggaaagaaaccattgaggaggccactacagtagtgtagttgttccagaatgaggcttcttcctgcctgtcccagctcttgcaagatcctccttcaaagctgccctttcccatctgagctcactaagagctcattactatgcaactcttttgagttgagagatatatcaatgatgtttcttattctgaatgaggctcctaatgttgtactgaagttgggtcaagggcttgaaaaaaaacagaagcttcatctgaatctcccagtttagatgaaagggaagtatgatacattatttccattgctgcaacagaatcagttggcttgatccctggggtcactggtctcctctaagatgccaacgtggtagggaaaggagggaaggggagagggagaaggagggagggaaggagagagagagaaagaggagagagagagagagagagagagagagagaacacgtactgccagcatggggcaaaacctgattgtcaagtgcttttctggggcctgttccagatcactgtcacttatagacttagactaaagttcagccttaaattagggctccaagctaggggatgggagatggaagggccccacctgggtcttagcagtgggaattaactctccctgatccttaattattttggcttttattagtggctagatggggagagggatgtaacctgaaccctaatgcagctgagaagggctaagagccaaaaccctctttaagcagatacagtatgtgcaaggtctgggcaggtttcagaacactgcacttttcttcagccaaaggcatgggaaaaacacgcaaattacatcttgagccccttacctccagaaaaggagagtatcagcctcccaccagggctcacgcaacagagggaagttagcaagcaggcgcttgtaaaaatcagagcacttgggcaatcttttacacaaaaatctccccagcagctacagattcaaatcaatttcaaatataaattacaagctatttcatgttgttagagagaggagctaggtaaaggaacccatgtggtcattagccttttagcaagaagtgactttagtctacaagaaggtagggaaggagttaatttagaccaggttgcatggcataagcatctttacaacattcggattttcagttcttcaccatgtagaaaatcgggtgatgttgcacaaaagtggcaacggaaaggcattccaagaagtgattcctatcacttcaagttctaagttatacaaaatgaactttagccagtaacacctcagttgacaaagcatcccacagattggaggagatagcaagacaaagctatggccaggaaagcccattaaataacaatgcaggtctgttctactatctttggggcataagattgtctggcaattaactcgtttccacaacaaccagtagattagtaaattgtctgtgttgatcattatgttcctaaaataatgctttgttgttttaactgatcagtggctttaaataaacatgctccccaactgcctagggactttttgattggcctacagacacttcagtctcagaagatccaaaactgaactaaacctggttggtcttcccaattcccataatctctcagagccttctagattttacatattagattaatccctgactcctacctcttcttcatttcttcaatggtatgcattatcactaacttctggcaactcactaatgtatgacaagtcagcaaattgccaagatgggctgattccttcaaaatgaccttacctatctattgttcagttcaggtctttcctcatggaagcaattatgtgactggtactgtgctaggtgctttattcttgagatcagatgagatcggacaggttcagggtggtatgaccatagactaggtgccttattcttaatacactgattatccaaaccacaaaatggctacctacttccaacttgcatccattctatagcccagttttctggggtatccagaatacctggctcaaatccattcacctttatatcccactagtctgcaagaatcaagaagatctccactgactcacttatgtagccatccacacaagcaatatgacattgggcaagtcacctaatctttcttcaatttcctcatgtgtaaaatggagttaataaattagctaacatggtgaaaccccatctctactaaaaatacaaaaattagccaggtgtggtggcacacgcctgtagtcccagctactcgggaggctgaggtaggagaatcgcttgaacccgggaggcggaggttgcagtgagccgagatcacgccactgcactccagcctggcaacagagagagactccgtctcaaaaaataaaataaaagagctaatatgtgttaagttagaaaactagtgcccagaatatgcactataaagtatttgttagaaaacaaataaaagtgacatctatggagctctgtgctggtttcattggccataggaagaatagctcagctcctagaacaggcactcaataaaatttaatgaatgaattaataagtggataaatgaacaaacactacatgctctgcccttatgctgttagtcaacacactgtggagtgaacaaactggtctcagtcttctgtctgtgtctttaggacatgcagtgcttgtagtaactggaatcaacgtccttcttcctcccaggcctacctacctaaatcctgtattatccctcaaggcctagctccaattcttccttttttcacaaaacacccagctacatcagcccacaatgaaatctcttcccactgaataaatgttgctcttagatcctaccccacagtttcagtacttaaagctttttgtttcctgggcttatagtaatgcagctcttcaacaaaactgtcatctcttttgagaatccagaaaccaggtcttctatggtggctaactcttgtattctctagtttagggttaggcactttacaaagtgctcaacaaatctgtgttgactggttggttggttagttgatcagttgattgattgattgattgattgattggaggcctaactgagagctcttaagatgttagcctttcaaagtgctggctgttcagacattagcagaaatcatggctggtcttccaactttttgcagtagcagacattacacgaaagctgccctgccatttcacataattcccaatgattaggtaacttcatacacttcaatttttaggctcaaaattttcttaagagaattcctgtttaataagggacacctgtggaatgcgcttgcttgctttcttacatcacatatactgctaataataatatgaaataaatgataaaatgaatctctctccctactggacaacagcgcaggttgtattactctcattttgcaaatagggcaattgagatagagagatgaaaatgacttcccagggtcacacaaatgaagagtggcagagttgggactaaactttaggctttctgaataccgacccagtccccttaccttgatttgagatttaaaacaaaacaaagaccttcctttgaccctgacctctgaggaatagatactcataatattatcagtttctgcatcaaatttcatttccctcatttccctccctccgtctgtcccccaacctctcattcttatctagttctcttctatttctctgtctttcacctgtgtaaacacactattttagaaagagcatgggatttgaagttggacagaagtaaatttgaatgtcagttgtcccacttactatatgacttagagtctttcacttaacttctcctgagtctcggttcttcatctgcacaatggagacattaatatctggcctcaaagagttactgtaaaagttaaatgaaaatacatgtaaaacacctagaaaatagcagtatttgctatacagcggtccactacctctccgatcccaccatgtctaggctttgaccacctttgggttcaagaggttactgaactcaatgaggcacagccacacaactgaagtatccaaatccttgcctggtctacttttgcttgttgtcttgatccttcctgatcgccaatttaagttaatacagagctccaaactcttgtcaaatcctctacagaatgtgagagtcaagcctgatacttaccccctgaagcttcaagatgtcatcactcacactctcagtcagagtaagatgccatccaaagctgcctacctgtagaatttttcagggtggcttttacttatatcaaacacaaacaaaaagaaatggaaaacagcaaggcagcccaacaaagacaaggctttagcttgtcatcctctcataagtaaagatggggctacagccataagactctaactcctttccagaataactagtcaaaccagctttacttctagctctacctcatctcacctccaaccccctccccgaaacgaaaaatcagtttcttatggaccgtgaaaggcagtataggagaaccattgaaaacttccctgccagaggctcaggaaaaaagagagaagatcatacagctaggaaactgttgagtggcattagggtgggggacagaagacaccacaaaggggctgttcgtaactgggcttaacccttgatcctgtcaaattagtcccacctcccgcattcctcacagatgtaacattaaaagagttgagtgaaagttaacagaccatgtcctccctgagaacataccaggaaacagccacttctagaaagataggaagtaggagtgtggagaaaagcaatgcactccaagagctgcctgctgtcagtcagccttcacacttccacagcctagaccaagtaagggtccttagcaacccttcagtaaagcaagaacttgtcccatggagggtatgagaagaaacaggagggtgtggagagccaaagtagcatgccatgattattcagcaagttgataaaagaatataagaacagagattctgtccatcactgaaacaggatagagagagatgcagtgtgaggaaatttccctctgattctgttatgatttgctgattgttttcaaacctatcaacctcaactctgtgagcttctctctccctcctccctacccaccacccctccccgccaccactggaagcatggctgagccaagagggacaaagctggtacagcagactagaagggctcactgtgaccaaaaaagaaaaaaaagttgggttttggacagagggcagggcagtcaatgaatgaacaaaggggcaatggcacttgaatgagacggtccaaaatgtaggcctcaagcaactggtgctcttgggtgggggatgggaactaaagacttgacatgaaagaaggacagcctagatgcatggaaaatgtgtctctgttgctactaggcagtacttgtgttgcgatatggtacagtcatagattcacagtgaaagaggaggatgtggatgtgaagtcaaaggggagaggttagagctcactttgaaagatcaagtcatcttgacttttgcaacttcagtgcgtggccaggatggctatctgaccaagcaaacatgccagtgtgatgtgaggaagaatggatcatccgttgcaacactaatgcgtaagacaatttttccacttggcctatttacactggatagggcaaagaggtataaggagacaaacctctaccccttcccagtccttggaacccaatctttagccataaaaaatagtaactcaacttattcattaatgattttattgaattatgtgtgaagggagtatatctcagggagcaccaggagacaaaattttggctccatggaagctgagtgaaagtgatcttgataccgacataaccaatataaaaacgttacttgctgattacaagataactctcagggaaacctggaattccgtttcagagggaaatgtaaccatgcacacacatctggtcccagcatcaaaggtatgaacaccttgggcactaatggtagcagaatcccaaactcccccagaactgtgtaacagagctatctagagcactttttgttcctaacttatgaatgcattgtttcccaagaatatcttctataaataagcagcttggagctttgaattctgtttcctgtagataggacattataaatgatggttaggttgtgtaatttaatcaatgatacactatggattaaataggcttctccagaactgttctgaatgtaaccattataaataacattgtgtcagtgaagacacgtttcctagacctctacactctcttcctcagaccccttacccttcagtaataatatagattaagccccactccaatccactccctgatcgaggctttagtagtaacgaaagatatttttccagctcagatgacaactggtaaatgtggggagatggggagaaagaggctgtggatgcaagacctccagcaggagtcactcttgtgtgtattccaggtacagacagaagaacccagagctgaaggatggcagcaacagcaggggcttttccaatcagtgtcagtggaggtatgcagggaaatatatatctgacagtggatagggacagagactgctgtctctatattcctacataggggctctgtaaattgaagagtgtatggcacatatggttagcatcttcaatcttggagacaactattctttccagaaggggaaaaaattaagttcagagaggtaaaaaggaaataaaaaagatctggaattctgactttgacactattcattaaatgccatttccttcttctattatacaaattccttctctgtaacttaataatctctttgtttaaacatacatgttccttgaagtcagggcttatatcttctctctcatctcccctacgatgcatttaccaaggctggccagggctaggggcagaggcaattctaaataaatagtaggagatgaaatgtgtccctcccaaatctattatgtggctgtcccagatgccttcatagaggccttaggcaggtatggcttaatagcagcacagctacttccattaaaagattttgacacagggccttggtatgacatggccgccagaaagagccaaagtgatcttcagctgtatttttttaaagaatgttcatactcaactgtggtcagattctcctcagttacagtattcagctgtgggatccataacttaagaggaacatggacaagctgaagtgcatcatgagtgggaggaggaaacaggaggagaggctggaatctacatcccataaggaacagctgaaagagctagggctctgctagaaaagtgaaacaagatgatataatatttgccttcagatatcccaagggctgtcccaagacagaggaagcacccttgttctgtgtgatgctatccagaggatacagctaggacccatggatgatcgctaaaaggaaaacgattgcagcttaacaaaggaaaagctgtccacagtcaaaactttccagcaacagaatggataggcttagaagggaatgagctcccctgtgactactgtagaacaagctcagggacactgcacaggaggctcatgaaatggttaagattagactaggtgacttctaaaaggctctctttactctgagattctttgattctaggtctctaccaagaacagaattactctgggagcactgagttaagtctgccccttggtgcttgaggggtagaggggcaggcagtgagagcagcccttcccataatccctgctgttcttcattaacttttctcagatgggtcagcatcttttttcccttagttctaaagaagtctaactataaaagccatgatgttccctccagataatcatccataacctccaatctcaagtctgagtctctcttttttctttaaagaaattcctggggagggggttggggaaggcaaggggggaaatcattttaatttttttaagggacaatggagttgaattattttctttgtgtgaagttttggagagggaaaatcctctaataggcttgaccttttttaacttcagcaagcatacatgtggctctcaatggggtaccaggtgtattatgaaaacccagcagggccaaaagtagtatcgactcaaagctcagccaagggttaccagccataccacccacccttcttgctccacctccctccaaccttctttgtatctctctgatggatttctaatccatgcctcaaaatgccctctactttctgggatagggcagcaggtgggaaactgaggtagtggacatctttggtgattctagaggcagaaatgaggaggggattcatgtaggtaaccaggctggactaagctccaaagatgcacaccccacgaaggtccctttgtgagtgccaggcactggtctgtaacacagctcaaaagatttcacaggaactctcattgttcacataataccacctctgcacccaataagaattcaaaatcacagccaaatttacttccagccacaagacaacctctatctgagtttatccagatcctcttgaagtctcaactgcctctctgtgtgcttctagaaataaggtcagactaggaatggaatacagactaaaacaacttgatgagcatgccctgccactgtcctaggctaaggatggcaaacactattagagtttgcctaattcattgtctcatcatctgtgataatagagatggggcagttatgcctaggccccactctgcaaatagagacttgggtctggagagtgtaaaattatatagcaatatcagagcacatcaagtggatgggagtaaagcttctttctcctccaggttactcccctaccccactctgttttgttccagggcagtaactagccccacttgcttcactatgccagatagaaacatctaccataaacgagccaagaaaagggaaaatatgttagcatgagcctacatatcatcagacacatctgattagaagagaatccccattccatccagacagtacttctgagtcaatgaggtagcgtaacatgttaaccaaaggaatcaataatgccaatgtcatgggccctattcctttatgggtcatgtatcttttacttgttaccatgatctcactcgaaacaccacaatatagggaaacatcataaactatcccttattatttaggataatcaatcgtattttattttttggaggtggggtcacactatgttgcccaatcatggtacactgcagcctggaattcctgggctctagggattcctcttacctaagcctcctgagtagctgggactacaggtgcaagacaccgcatccagcaatagtattaaaaaattttctctttctttgccacttgactgtcggggggtactatacaagtgtccataaatcaggcagttgaattccccatattcagggaaatcataggaaccagcaggaattgatgatttccccaacttgatcatttcctggtccaaagggtctcccatgacaactatgaactagactttcacactgcataccctcttcccccactaatcactactttttcaaattcccccactccccagatatctccacttgtgccacaagatatctctgagcatgtatgccacaccatccctgatgcaaaccgcttctggttttttttccacaaaggaggttctctgccattttccaccatgcttcctgcaccttacctctgtctctccctgacctgagatcatcacaagtgatttggggtcatcaaaatagtcctttcctactctgagcccagactccatcagagtgtacctacaacccagtccgtcaccaagtatggaattacaggctggcatggaaagggacactgcattaggaggctaataagactagatacatccctgaaagttattgccctgtgctccttcacaaaccacagtactaacagaagaatcagaaactctcttagtaggactgccattgactctcagtatgatagacataggtaagccactgaatacatcagtctcgggttttccatcagtttctccacaatctttcctgactgcctcacagtgtagctgcaagagagtaatgaaataaaggatgaggaagcacattgtaaatagtaacactgtatgcaaatgaagcaaagcttcattttcctcactctgcagcaacacttctgagaagagagccagagctagcataaaagattagctatttggccaggagtggtggctcacgcctgtaatcccagcactttgggaggctgaggcaggcagattgtttgaaggagttggagaccagtttgggcaacatggtgaaatacaaaaatacaaaaatacaaaaaatcagccaagcatggtagcgtgtgcctgtagtcccagctacttgggaggctgaggtgggagggttgcttgagcctgggaggcacaggatgcagtgagccgagctggcaccactgtactccagcctgagcaacagagtgagaccctgtctcaaaaacaaacaaacaaaaacatggctactagattgtcatagtatcatttaaagaccacccacttgaatgtcattttagatatggggatgcctagacccaggtagggcaagtgatatacctaggattccagaactagagagtggcagaaaaaggattagaacccaagtttttaatctgccaacccaattatctttctattaccttccacccatcccaaccagtgtgtacagactaagaaggctgttttcaaggagaaagctgtattgttctgaatcataaaaggaaataaaatcaaggttgaaaaatgaagagggaattaatgaaatatgccaaaacagtgtcttgtcaagaaaaacacaatacaggcaatcattgtgcttaaaaaaatactatggtccctttatataccgttgaagccaacccagttataactgacttttactgttaagaactaggctatttgggaggaatgggagaaataattttatcccttgcatatctaaatgcatgtcataatgagccttcatataataggggtcaactgtacattcagtggaaagggaatcattaaaaggcaccctgcctctcaacacacgaagcacttcctctacagcttggccaaggaaaccctcatctaccctctcaaataatcccccagccagaccacaaattgctggctgccccatacttagtaacaccccctgccatgctctcactggctcacaaaataatccgggaccacagcagcaagcactctctggggtgcttctcaagatgggtcagctctgggcagagctgaaaaatgacctctccaaggcaggttgtctaggcagactgtggaaattctgtgggcggtgtgaggagaaaaagaaagggaggaactgccagatcatggagggctgcatatcccattgtgaccttggtggaaagagtggggagaggaggagcttgattagaagaaattcctgaaggccaggattcccctcaccaaaggagttgagtgtttttgttaaaaaaaaaaaaaaaaaaaaaaagcatataactttctccagagaacactggagggagactgcctcaggaggggttgtgacagtggatgacaaacgcatctcaggctggttaaagtacatgacaagtatgggggaaagggtgctggatgaagatctgggctagtttggggaggctaatgatcagaggggtccctgccagcccctcaaaatgttgcctcagcatacctcagactcctcaatctgattggtacacccatggcaacactccagggttgctaagagtgtgggccccaaggcctgaaggatcccatacactggaagtcaaccacaggctccaatgcaaggcgaatgccgcacaggttattgtgggtgtgtgttgcggtggacgtttgctgaaccctctgctgagatgtgaccaatgttgaaccccacccccccgcaaaaaaaaagtgatatttgctccctgctgaaaagacacatctttctatctccagcctgaacccacatctacaacttcaactgccatttaagcgggttggaagcgggagggcttttcggatttgaggatttaagagaaacaacaaaaaagtggaataaagttcgtaaagtccgttcacttggcaatctggcacctcaaggtgagtcgtcccacaagtcactcttcctggtaacagctccagctgcccctacccctcgccctcacccctacgggggaggctcgctttgggggttctggagcactcaggagagctcctctctcctgtcctcagctgcaacttggcttccagcagatcacagactcctaaaacaaacaaaccctggcggcggcggcggcggcggcagtggcggcggcggcggcggcggcggcggcagcggcagcagcaacagcagtagctccagcacagctgcgctccatggcgcaagtttcctccacacttctcaacgtgcaggaaatctcgccggcgctggggcaggactctggagggagggagaggccgagccgaaccggcggcaacaacgccccaagagctgaatggatgtgtgcgcgtccggccgtgggaagtgtggctggcaaaagccaccaatggcctcatctccgttcccacaccagcccctagccctgcaacctgcctgggagggacggcccgccggtcgatagaggggacaacgctgccaagagagctgccaagccgcgatgactgtcccttcagtccttcactgtcccgcagggacgcagaggcctccaaggagaaatccccaacagcctccacttccttcggcccaaactgagggaagtagccgccccgacgtggggcagcaagggctgccccagcgccctcgcgagtgtgtctgcgcgcaaggttctagccgggggccagttgtgctcccagctcgtgttccagccacccttaggggatgtctgcacctggactggtggcaagacccctccgtgccgctcagagggtctttcgctcccagccctaagtttcaaagttggcctgagggccccgtccagcggcagccttcgcacccgcttgtccattcaaagttaggcgccgttaggacatcagccgccagttcttaccttagacactgtgagcggctcacagtgttccagaccccccttaagggtgaagccccagggtgcccccccttgcagctgcacagggacgtactggaaggacccaggccggttctccatcctcggctgggctcaggcgccgccgggctccttttccgagggggctacgttgcctccgcccccagcagctccgccaccatcgccctccagctctacgccaccccgcaccgccctgctccgcctactctcccggctggagacgctcaggcagcgagcgagcgcaaggaggaaatgacacggagctggagaaagggggagagaggggggaaaaggagaagggaaaaaaagaaaagaaaagaaagaaggagaggcggagggatagcgcgtaatggacaagaaaacggagcaatggggaggggcagtcactgggacctcgcctataggatcgctggggagtgggagcgaggcgaggcctcacatcaattgttacattgtttcattcaagcagggcccctctttggtcctcctctttactgccgggttccccgcccctccagccagcccaggcgaggggaggtgaaagtcgttagtgtggacggcccgcgtggctgagtgggctgaaacgctggtttcctgattagcgcgttcatgtttctctgactgcctttttcttctgaaggtcccgagaacggagacctgggagggttaaaaggctgctaatttgtggaccttgcctagaggggtggaaagcaaagccagcaggccagcggacatagtgaggctgtgtgtgtagactgctctgtgtgtacgcgctaggtgtgtggggtcattatgaaacattgccccagagcatagtttaaataaagaagcactttgaggatgccccctgctcgggctcccccgcaccctggctcagtgttggtgtctatggctagcactgtgcttgtgtatgttccagtcatctggagttcctggcacggccttgcacttgccccaccgagatgagcaagccagcaatcagcaaactttatgactagcagtattgtctctaaacaaacctacaggaaagagcatccattgataagctggccaattaataatgttgtgcctttgggaagaatcagcttttagactgggtccagaacatctctgcacatctgttcaagcttgaccttgtagtttctgagctgggcttttgtaatagaccaaacagccacaataatagtcctgaaaagcgaatttgttactgaatcttgtgctgatttctctgccttcacttggacaggttatcttctctctttgaggtgttttctctggagccacatgcgggcagtgaatttttaaagggcctcgcactagcggagaaagtgttgacaactcagttgtgactcaacaggatgttcccactctgtctcgcctgttcagtttcttcccctgttcttgtgcagcttcttcttcatggccaacaaacacactgcggccccttccttcacagccagctttctgcggtcaaggtttccactctctacttctacttcctcacctgtcactgcctcttcaacgcacagcagcctgcggtgtgctgcagcaggccactgaaatgtctctcaaagtcacccccctccatcaatccttttttcttagcacccccctggactgtctgcatatatgatgctgccctgacttttctttaataaaatggcaatttaggtgtttatagcctgcctttttaaagtccttagagatgatgcacatgggaaaccatcctcgatcttttaggcctacaaacaccgtcttgatcatgtttattgttttatattttccttatttgaaagcagaaaatttgataaaatggcaactcaacttgttgattcttacttgtgttaacctatgttataacattcatttgccctgccccaccttgaaactcagcattttttttctttttcggataatatttctatgattgtaacttggtagaatccagcgtgtttcagtcccagcatatctgtaaagttcagttcacaggatatatagtcatcactcaaggactattagaattatgtgtctagactagaggaaagacgtttggaagcagtagacacacatctgagccctggccttgtcactaactagatgggtgaccttgggcaaatcactgagctaactcttttcagtctcctgttcttcctctgtaaactttagctaataagccctgactttcctacctcccaggactgttgagagactaagatgaaataatacatatgaaaacactttggtaaggaaaaagtaaaaatcctctcacaaccttattatgaaagcaagcactgagctagtctttaactaacctattttcattccaagccttactctacaatgatgtcttgttgcactcttcagtttatccttttcatcattacagcagaacataaattacctagccccttgtacaaacagtgcataagtagtagatattctgaacataaggtggctagattatcttgcttctttattgataaaaatcagtgctgctagcaggcatctcattcttctttggaagtatacagttagtggtagcatgactgcatagtggaaagggtacagggtagaacttgagatgcctagattctaagctagttctgccattaattcactgtggatattaagcatgtcacccccactctctgtaagttgaaggggttgagcgacttgatttcttaagttcctctacagtttacaaattctgtgactacttcctggcaagtgcctgaacgtagtatatgtgcaaacaaaatcttgatagagttgaaccaagtaaaaagaaagcaatggagaacattcgaggggtatattactctgtgtgtgtgtgtgtgtgtgtgtgtgtgtgtgtgtgtaaagtgcatgcacacgctggagctatcagacagatgataaattcattctaaagtatgttaaattgcctgtggggaaaaggtggaaagtccactaggcaggtagaaataggaaactgcatatcaaggaaggggtggtgattgataatacacacttggatgataactgaagccattatttgcagtatataatctcactcagagaaattagaatctcacccagaaagtagaatcctggattatgctaatatttaaaatatgctaatattcaaaagtcaggaaggataacaaaagacccacaagggagtagacacaggaggtgggcaaaaggccaaccagggagagataaattaaaaccaggctaggtacttccacctcattaaacattcctctcaggagtcttgtattcattcaaaagctattgagaagtttacatttttggaagaaggaagactgaaatagcagtccttctctgagctttttttttttaaaacttccttagctgaaccttttttctaaactcaaatttgaatacaattttcctcatcgcagtgcctgtagcttttttgtttttgttatcatttttaaaaattttatttttccctcccctgtgggatctaatctaactcctttttgaatgaggaacctcttgagattctagagaaacctatgcactctctccccctgaaagctacacatgttcacacaatgctatatatagtttgggctgagattatagaccctagcttcagaatccttgctctaggctgggtgtggtgactcacgcctgtaatcccagcactttgggaggcctaggcgggtggatgaggtcaggagttggagaccagctggccaacatggcgaaaatccttctccactgaaaaaaaaacacaaaaattagccgggcgtggtggcacgcgcctgtacttccagctacttggggaggctgaggcaggagaatcacttgaacccgggaggtggaggttgcagtgagctgagattgcgccactgcactccagcctgggcaacagagtgatactctatctcaaaaacaaaaacaaaaatatccttgctctagaaaaagacaagatttgttctttttgtgtgtgtggtaaaagcaaaaaaacaaacaaaaaaaaacacaaacaaaacaaaaaaaccacacgtatcatgaagtctaccctcgtaacaaatttttaattgtacagaacagtatttataattttatgtacattgttgtacaccagatctctagaacttcttcatattgcacgattgaatctacctaaattgaacaagaactctcgcctcacacccagcctgttggtgaccaccactctactttctgcttctatgagtttgactactttagatacctcatataagtgaaatcatgtagcatttgtcttcctgtgactgcattatttcacttagcataatgtcctccaggtttatgcatgttatttcatatgacaggatttccttctttttttaaaggctgaataagattcaatttcatataaaaaatacacattttttctttattcattcatctgtcaatgagcatttcttccagctttattgaggtatatttgaaaaataaaattgtatatttttaagatgtacaatataatgatttatattggcatacattgtaaaacgattaccacaatcagctaattaacacatctatcacgtcacagctgccattttttgcatgtgtgtggtaagaagacataagatctactgtcttagcagatttcaaatataaaacacagcattattaactatagtcactatgctgcatgttagatccccagaacttattgattttataagtgaagatttgtaccatttgaccaacatctttccatttcccacacccccagccatataagtgagatcatgcagtaatgcagtatttgtctttctgtttttggcttatctcatttagcataatgtcctcccagttcatccattttgtcaaaaatgtcaggatttccttcttctttaaatgaaggggtacacacatatatatagagttatgcatcacttcatgactgggatatgtgctgagaaatgcattgttaggcaatttcattatcgtgtgagcatcacagagtgtacttacacaaacctatatggtatagtctactacacacctaggctatatagtatagcctattgcttctaggctgtaaacctgtacaacatgttgctatactgaatactgtaggcaattgtaacacaatggcaagtatttgtgtatctaaacatatctaaacctagaaaatgtacagtaaaaatatagtataaaagataaaaatggcacatctgtaaagggcatttatgaagggagcttggagaactgaaagttgctctgggtgagtcagtgagtgagtggtgagtgaatgtgaaggcctaggacattcctgtacactactgtggattctataaataatgtacacttgagctacactaaatttatttaacattttttctttcttcaataataaattaaccttaacgtattgtaacttttttacttttaaacttttagatttttttttattttgtaataacacctagcttaaaacacaaacacattgtatagctatacaaaaatattttctttatatccttattccataaacatttttctatttttatttttttacattttaaaccttctggttaaaaactaacacacaagcacacaatttagcctagacctacacaggattagaatcatcaagatgtcactaggtgataggactttttcagctccattataatcttatgagactaccattgtatattcagtcagctgttgatcaaaatattatcacgtgtcacataactgtgtatgcgtgtgtatgcgtgtgtgtatacaaaacattttaaatctattcttccatcaacagattcttagatcatttccatattttgactactgtgataatgctgcaatgaacatggcagtgcagatatcttttcaaaatactgatttcaattcctttaaatatataccaagcaatgggattactggatcatatggtagttctatttttattttttgaggaacctccatactgttttccataatggctacagtaatttacattcctgccaacagtgtacagtgtatgagggtttctttctttacatttttgccaacacttgttatctctatagagttatcactacggaaaaccacccaactgcaaaaataaacaataaaagaggaagaaaaaaagaatatacaaaacaaccagaaaataaacaatacaatgacaggagtaatcttcccctatcaataataacctcgaatgtaatatgttttgaagtcagtaagtgtgaggcctccagttttgtttttctttctgaagattgttttggatatttggcttcctttgtggttctatatggattttaggagtttttcttttttctttctttctttcttttttttttttttaagatggagtctcgctctgttgcccagcctggagtgcggtggtgcgatctaggcactgcaacctccacctcccaggctcaagtgattctcctgcctcagcctcccaagtagctgggactacaggcgcccgccaccatggtcagctaatttttgtatttttaatagagatgggttttcaccatattggccaggctggtctcgaactcctgaccttgtgatctgccccccccgccccccgcccccgccaacttggcctcccaaagtgctgggattataggcgtgagccaccgcgcctggccaattttagggatttttctactcatgaaaaaaaatgcctttggagttttgatagagattgcactgaatctgtagatcactttgggtatggactaaaagaacatttgttaacaatcaacaaagtgaagaaacaacccacagaataaaagaaaatatttgtgaactacccatctgacaagggattaataaccagaatatataaggaactcaaacaactcaatagttaaacacacacacacacacacacacacacacacacacacacacacgaatactccaactaaaaaacaggctaaaggtctgaatagacttttctcaaaagacatacaaatggccaacaggtttatgaaaaaaatgctcaatatcactaattatcagagaaatgcaaatcaagatcacaattagatatcacatcaccctaccccagctaaaatcacttttatcaaaaagagataataatggatggggagaaaggagaaccttcatatactgttggttggaatacaatttaatacagccagtatggaaaacagcatggaggttcttcaaaaaactaaaaatggaagcaccatatgacccagcaatcccactacggttatttatctgatagaaaggaaaccgatatatcaaagagatatctgcactaccatgtttatttcagcactattcacagtaggcaaaatatgaaatcaacctaagtgtccatcaatgcatgaatggataaaggaaatgtggtatatatacacaatggagtattagtcagtcataataaaagaatgaggttggatgtggtggctcatgtctgtaatcccagcactttaggaggccaaggtggaaagattgcttaagcccaggagttcaagaccagcccgggcaacatagggagttcctatctctaccaaaaataaaataaaaaaaatagctgagcatgatgatgcacacctgtagtcccaggtacttaggggtggtgaggtgggaggattgtttgagcccaggaggtcaggaggtcaggaaatcaaggctgcagtgagccatgatcctgccactatgctccagcctccatgacagagtgcaaaacctttctccaaaaataaaaaaaaataaaataatgaaatcctttcatttgcagccacatggatggaactggaggtcattatgttaagtgaactaagccaagtacagacagacaaacatcacatgttatcactcttacgggagctaaaaaaaagtgtatctcggccgggtgtggtggctcacacctgtaatcccagcactttgggaggacaaggtgggtggatcatgaggtcaggagattgagaccatcctggccaacatagtgaaaccccgtctctactaaaaatacaaaaaaaaaaaaaaaaattagctgggtgtggttgcgcatgcctgtaatccagctactcgggaggctgaggcaggagaatcacttaaacctggggggcgaagactgcagtgagcctagatcgagctactgcactccagcctggcgacagagcgagactctgtctcaaaaaaaaaaaaaaaaaaagaagaaaaaaaagtgtatctcatgaagatagagagtagatttgtgatcaccagaggctgggaagggtagagggaagggggaaatgaagagaggtttattaatgagtaagaatatataacgtgataaaagaaataagacccagtgtttgatggatcagtagagtgactatagtttaaaatagtctattatatatttcaaaatagctagaagagaatacttcaaatgtttcttgattaaagagaggcaaattaaggtgatggatatcccaattacatggatttgatttctacaaattatatgaatgtattaaattatcacatgtaccccgaaaataacatacatctattatatattgataaaaatgaaattattttaaaaggttctcttaaagagcttacatatttactgaaccaatctttctttcctttttctttcttacttccttccttttttatttcttccttccttccttctttctttctctctctattccttccttcctttctcttttcttttcctttcttttattttcttttttcttttcttttgagacaggatctcactctgtcacccagactggagtgcagttgtgtgatcacggctcactgcagcctctaattcctgggctcaagtgatcctcccttcagcctcctgagtagctgagactacacacatgcactacaatgcacagataaattttgtactttttgtagatatggggtcttttatattgcccagactgaaagaatgtttcaatagaaaaaaatattcactgccaggtgcggtagctcacgcctgtaatcccagcactttgggaggcagaggcgggtggatcacctgaggtcaggagttcgagaccagcctggccaacatggtgaaaccccgtctctactaaaaatacaaaaattagccagacgtggtggtgggtgcctgtaattccagctacttgggaggctgaggtaggagaatcacttgaacccgggaggtggagtttgcagtgagtggagattgtgccattgcactccagtctgggcgacaagagtgaaactccgtctcaaaacaaaaaacaaacaaacaaaagaaacaaaacaaggaaaaggtattcactcagtaagttaaatttgccctagactgaaagaatgcttgctaagcactaggtactgtgcaaggcatgttccatatattattggcaagtattataataggcctacaaagtaggcattattaagtctgttttccaagtgaggaaactgctccatgaagtggtagaaccgagattgtaaggcagggaggttgcagaagcatcctgtgataactttatttatcatgtctctatcatagtcccctcttttgcagagaaggaagggagttggagtcctccgttttgctctcctcatgtttccacatgggaggacttctgttagaataacactcctggcctgtctccccctcttcatgtgatgggtgagttggcaagtctgtatcgctaagtgtagggagtattaggaagcctattatggcagactttctattccctatcttccaatacagactttaacagtgataaactgatagttttaatctctgtttatttccttcctgtgtctatcagttggttctgaacttgggaatgaatgagaggtgtgctactattcactactgttccaaaatgtatttattcaacctattttctaatcagcctgtgtccttctgtccacttatctattccatattgtctcctgagtgtctgtgtgagcctgtctgtgaatgtacctctgattgcctagatacctataacaggaagtgtgtgtgggtattaggccaaagctccatgtggtcctaaggaaaatgatctgcatgtgcatgggtgaaagaaggagagagaatgaaggtgtgttccttgaatttggctctgagggctaccttcacataactatcataatgctttttgtcctttactagaagcaggctctaccagaaaagaatgcttaagcccatttctttgccgattgtttcattctggggccacagaccttcctcttctcatctctgtgctagcagtgtcagaagagggagagcagtcactatttcagaagccttttctgtgctggctcaaagattgaagattgtttacagactaaggaaattctcatttttcataggcagattataatactaaagaaatctaacctgtgttttgtgattgttatctagcattctgtggcccgtacttctaacatacttgataaatgatgtcaagtcatcttcttaatttcatcacacccttgggaaaaataaggtaagagtcagaattatagtcacccttttacagatgaaaccaaaggtaaaatagtttcattgcttaactaatcattcttcctacacttccttggaatttcaggtgttggtgggccgactattcctgggccagttgcctaacaggcaaaaggggaaccagaccatgttttaatgaaacagattttgtcagaagtaatatcaaaaggtgttcatttttagtctcatcagttgaatctcttggagtattccacgtgggtttctagggcctctgtttctctccttccccatttaccctacgctgcccaaacaattaccctgacacttctggatgtttctcacaggggagagaatctgggtcaataatcataggcagtggagaggggaaaaaagttgaatgttctaggtattattcatatgcagattacatgaaaatagtagcaagtttctccttcccatttatctatacatctaagggtgtgcaggtatgtaagggacgggcaggtgcagcaaaggagaattctaagtagaccgtcctactaaagagtgtgtctgattcctgggaaattttgcctagggctagggaaagatttatagtcaaggtctgtttattttgagttaaagttagtataacattagtataaaatgttatagctgacattatttaaggtaaataaattcttataagtacatacttctggagaaatatggagtttatgttgctccttgggtaactttataaaaaaatctttctgttgttgaagtgtctcttctgggtcatctggttcttttatccattcagaaaaaaatgccagttttcttatggaatctcaggatcttggcttcgtattagatttgagactagattcaaagcctcttcatccttcttgagttaataaatctagacagcattcgtgtgtgtgtgtgtgtgtgtgtgtgtgtgtgtgtgtgtgtaaaaggctgctatctgtggtggttggtgctctcagagaaggcttgttgaagcaggagttggtttgtttgtgtcctaagctcacagtagtgtcagctcaattggaaactctccatttgcccttggggaagtcactcacttggtacaagtttagctgggctgtgatgcatgtttgccattgctctagagaagtttcagccagcaattgactccttcctcatagcaaggatgtaaaaatcagatgaactgctcagatccaatatgtgggctgaaagatggcctcttctgggtacccagttcagacaggggctaccccttgctttgagctgtgtgttagccaatttattctatttcccaaatactgttttctgtgagccattactacttgataattcataaagtaaattttcagcacatgttaagctctgacctcaattcatccaaccatggaaagaaaaaaagtcacacatgcatatacgcacaaaccccagctttaactttttccccttccaaagttgttcatcattttgccctcctatagtgacagagaaagtacaccaattcattgggcatttgagcaagataaagccctcactacagttttggtgaagctcttgagaaatacacagatggcagtcaaaagaactatttgtggtgtcagggatacacacacaaacatatgcacatattcaacaagtcatgggaggtgagacatgggtgatgtgcagttgaggcagacagatagaaaatgggatgggaagcttgagagtttggtttgttttactcccttgccccgtattttccagatatacattagatagatatatagatagatagattcttctttcctttttgataatttatttttactcttgacttagtagaaatgaccccatctgtgatatattagctaaagagaaaatcattttgctttggttcagatccagaatgacctagcccaaagaggaaagaatgaccagctgcctttgtccaggagtgtcagaggggcttctgaaaagaattgctttctccaaatattttctttgggggaagtagtcccaggcatgtgtacatgtgcctggatgtgtgcacatacacccttctacccatacggacacatgaacaaactcatacataagactttatgttcaaattggggaaacctgcttttttctgagagtctggcagctcaacttactagagaaagaggttcctaaattctgaaacaattgtcaagagtctctttggaaacacttccttgacgttctaatatatagggcattttcagtgtttttttttttctgtcattggtttagagtaaacttcagaaacctggaaatgatacttaactctttcttttctctcctcctatcacctatgtccactcaatcatcaagccctgtcatttctggtcctaaattagttcttacatcagtccacttctctccatgcccactgccactccatcgccatctcacacctagaccattgcaataccttcctaacaaggttctctgatgcctgcagttctgcccagatgcatctaatccattctccacgttgcagtacagttgacctttaaacaacatgtgtttgaactacgtgggtctactcatacatggattgttctcaaccaaaggtggattgaaaatacagtattcactggatgcaaaatccacatatacaggggcccaatttttcttatctatgggttccacagggctgactgtaggacctgagtatgcacggattttggtatgggagggtgtcttggaaccaatcccctacgtatactgagggacaactgtactttgcagccagggtgctctttctgaagcacaagctatgtcactcccctgtccaattttcttcaatggttcctcattgcttactgaataaattctgagttccttgattaagactcttaatacatggatcctgcctacataatacccagcactctacccccatgccccctcaactctgttccctttcccccccaacacatggctctctgaaagtaccaaattatgcatggtttcaagtacaacctgttctcttgtaactctcagcctttttataagctattatttctttctggaataccctccacttcatccttgtccatctggtaaacctctactccttcttcaagtcagtacagaattcacacttatagaaagaaaccttcctttgcacccttaatcaaccttagactgttctcccttgatattcttactacctcctttgtatctctctattatggtgctgcttatattttattgtacttgtttctttccctgtgctggatattctgtgagggcaggaaccatgtctggatcctcaatatgttcctcagtacaggacctggacatagtcgatgttcaatcatcgctaaatacatgacgtgggcctggaataccaaaggcatttttggttatataagaataactttctggctattgtgttgatagatcttttaatcatggagtggaatatgaggcttgccccacgtagagtggccagcaaatgggacacctcagagaggctcctctagtgacttagaacccaaaaaagaaccctgggactaacccagctccaggcctaggaaacgttctactttgatgctgtttactgttacatgctactggagaactaatacaaaaatgtaacaatttggctggattatagacaaggactataaggaatgttaattgtcatcttcttaacatgtattccaggtgctccacaaactgacccctgcctgggtttccagctttgtcattccctcctctgactcacactttaccctctggccacaccaaactgcttacagcacctgctatgtcatgatgtgtcatacctctatgtttttatccatgctgtctttctgcccagagtagcttttcctttgcttaggtaattcctactaacaatttaagacttagctcgggcctcacttcttccaggaagccatttctaactaatcaacatgcacacacacacacacacactgagtctagatagatgtctctatgaatcaggactcttttgcttgtaagtcacagaaatacaatgcaaatatgcttaagccaaaagaagggggttattgatactaagaaaaattcaggcataattttaggcagttctagatccaggtgctcaaatggtgtctcagcaatctccttctatctcttggctctgatttctcctatattaactaaactctcaagcaaattttcccacatgatggccaagatagccatcaagaactatagatttgcatcttaccatttagcaaccccagtggaaacacagatccattttcttaaaagtcccagcgaaagttccagaattgagtacatgtctgaaccaaccacaatgaccaaagaaacagaatctaggtgggatgagacctgataccaaaagcagatatgttgggcagcaaaagcactatatgcttatactcagttttcctcttctatgctcccatattcctctcccccaccagtaactctgattacactgtatcattttgtgtgtgtgtgtgtgtgtgtgtgtgtgtgtgtgtgtgtacctgtctcctccactagagtgtgagttcctatgtttatttgcctctgtattgctagaggtcagtatgggggcttggcttctagtaggtgctctcaatcaatgaaggatgaatgaatggctctgccgtgcatttttaacagatgattaaattacagagagcgatactgaaagccaaatccaggcaaacagtttaatttgatacttagacaaattaataacatgactctaatttatttggttatatgcataattattactgggttgcatggtaaagaggcataaatagtaaacggttcatttgacgttctaaatgtaataaatgtcttctatgggtcggggctgtactagacactaagattagcctttgcctgttcattaaccccttaacattaatggaagtcagtatagtatagtggttgtggctctagggtcctggattgaactaacatctgcatttactataatagttcagtgaccttcggctggttacttaaccactgtgcctagtttcctcttctgccaaatgggaatagtaccaaccatatagggttgttgtgaggattaaatgcagaaattgatatgaagcattgagaatcatgcctggaatatttttaagtgcttaataagtgttaactcttatggttaggtattaacagcagctcctccctacttaaatatcactttacctattacacttgacctgaggcaaagccctgggttagagatttaaaattgagcttaaatataccttctgggcttcaataaaagaaaattcaacagaatggtagctcatctctggcctggcggattctattttattatggaacttacgatcttggatctctcagtgtgaaaagattatttcgcagtcagccagtttccaagcctcatgaatccagagaaggaagaagtggtctttcccctcggggaagagttggtgatccacaaaagctaggaaaagactttcttaaattctaacattaccacttcatatggcttactatgagaactggagtacaaacaaatagcttgtgtggctgaccaggttttgctaacaacgtatattggttctaagtggagcctttgatgtaatgatgagaggataacatttggaggtcagcggacatatgctggaatccaagctctcctctttactgactatggcatcttaggtaataataatgattacagcttagtgtgagtgcttactgtgtgcttgtcactgtttaaagcacttttcatgtattacttcctttagttcttgcaaacaatcttataaggtaagcttttatattaatcttcctttaccagtggaagaggttgaagggcagagaaattaagtaacttgcctaaagtcacataactagtaacatgggaagccaggtttccaacgagcttttgctaccaatttacgcctagtgttccattattggaacgctaagcatgtgggagttatttatatcctactgctcaacgtcatcgcaaaggtctgattgcaaaaattaaaaaaattgcaacctcaggcataaatgggttaaccacctcttcatgttgtctgccagctcaacctctctgagcctcagcttcttcatctataaaatcgacttaattgtaccaatctcagtgttgctatgagaattcaagataagctcggggaagcatttagcacaatattggacacatggaaagtgctctttgaataagcattgctattattctgtttctccattgtccctagaagcaggggcctggacttcccttccttattgccaatgctacttcttgattctaattagtctgagtacaaattattttctgtatgacggagatactactaggttaattacaaaacggagaaaactttgttgccaaagatagttattagtccatcctcaaaccgttattttgccttctgtttcttggttacagcactcaccaggtcccccaacactggctgatgtccgttcccactgtcaacctaagctttcccaactggggctcctgccaggctgggtgtacttccacctgccatctcattatggaacagtagatctgaaaagtaatgaaatgttagactgctgggagaccccatggacacaaatttatctcaaatggatttaaaattgtagccagttatttcattccttaattgtaatattttctttattgatgccttcctgctattttgagtatatacctcatcatagaagcaataaagattaaactcaactaaaaacatggaaagaaaaatggctactaaaaaatccatttgccatgatgagcctgccctcttacaactacaatgcaaataggtccgatcctttgggaaactggcttggtaatttgcttcacgaaccataattatgttcctgccctttaatactacaattcctctctggggattctgtcctaaggacagactttagcagaagtaaaacaaaagcctatagacacaaagattgtcaatgcaatattacttttgctaatgagaaatggaaaataatctaaatgttgagcaatttgatatatattagggcctatcagtaaatgaaatatgaatgataaaagatttactttaaaatattaaatgaatacattacaaagcagttacaacaatgtaaaattgtattatatggatacaacctagaaaggactgcagaaaatgaaaattcttatgttaggacgtgggtcaaagtatagtctattcctccacactcaatgcctttgattattgatgtcagaattagaagttttaatgtgtgtttgggtaggaggtggggagtgggaaggagttggagaaggaatttcaaattccagcccttttaactctatttcctgatcatcaccttagaagtaacaccatctaagaaattgacctaattttgtttttaaataaaaagatatacagtagccatatccactcatccaatcagacatacatattcagtcaggctcccactttccagtccttccttttcttgtccccttgtggcatacagcaggacataggagcaaacatgctcatatttccatccctgaactgtcactatcacctgtgtgaccttaagcatgttactttagcttatctacactaaggcctagtttgttcatttgaataatggggctaataatgttacttacattttgagttggtatgagaattaaataagttaatgcatgcaaaatgttaacatagtatgctattgactagatgttcatgtcccttcaaaattcatatgttgaaatccaaagcccaatgtgagagtattaaaaggtggagccttttggaggtgatttaggtcataaggaaccctcataaatggaattagtgcccttataaacaaggcttcagagagcttttgccccttctgccatgtgagggcacaacaaaaagatggccatctatgaactagaaagctggcccttaccagacatgaacctgccatcagcttgatcttggacttccctgcctccagaactgtgagaaataaatttctgggttttttttttttttcatttttgagacacagtctcgctgtgtctcctaggctggagtacagtggtgtgatcatggctcattgcatcgtcaaccttctgggctcaagtgattctcccacttcagactcctgaagagcttgcaccaaaggcatgcatcaacacacctggctaatttgtttatatattttttgtagagatagggtctcactatgtttcccaggctggtctcgaactcctaggttcaagcaatcctcccacctctgcctcccaaattgatgggattacaagtgtgagccactgcacccagccttctgttgtttataagccactcagcctatggtattttttatagcagcccaaacagaatatacacagtacctggtatcatgcaaatgctgaataagtgttagtttctggctataaaattgagataataccagtacctacctcagagggtttatagggattaattgggagaataaatgtcacacccctggccaaataggtgttaaatgtatggtaagtatcatcatcaaaattgttgcactgggcagtctcttccggtaacaaattatcagataatggagggagcatttaatgatcatgctgatactgatcagattggtgcctggagagaagtacctgctaaaaatttgtctaagcaagcagtacaaagcacagtaatctgaaggtcaaggggagcatgaggtggtgattcagcagggaaaacatttgcagaatagagacaaagctcttttcaaaaccacgaagaaactggaaagtaagcaggatggttaatgcagattatagaaatctatggggcagctcccaaagaagtatactaagaggtcagaggcaagtcagctagaaaaccttaaaagaaattttaggagagttgagcaaaagtgggaggtgtgatttgaggctagaaaagaacagggctggccgggcgcggtggctcacgcctttagtcccagaactttgggagtcctaggccagtggatcacccaaggtcaagagtttgagtccagcctgaccaacatggtgaaaccttgtctctactaaatacaaaaaattagctgggcatggtggtgcatgcttgtaatcccagctacttgggaggctgaggcaggagaatcacttgaacatgggaggtggagattgcagtgagccaagattgcgtcattacactctagcctgggtaacaagggtgaaactccatctcaaaaaagaaaagaaaagaagagaaaagaatgggcctaatgataatagctaatacaaaatctgtatttatttagcacttactatttttcaagcattgtgctaagcaattcatgtgcattataaaactttgtcttccttatcctatgaggtaaatttttattattacctctgtagtatagtctaggcccacataaaaccttatattataccaagccccaaaagagtggtttctggaaataagtcattgaatgtggtttagagggtccaagattaaattcatcatctttcatcaaggaatccatcctttgctctgtacttgccatcatagcactaccatccactcagtcacctacatcagaaacttgggagtaactactgagttttcattttttaggtaaaccagtcactaaggccttcccatttttctttctaaatattaatacttctcaaatccatcttttcttctctatcttctgtagggtcctcatcttcccctacctggagtatgctagtagtgtcctatctggattccctgcctctagttttgacttccttgtaatttatcctacaaagattgctttgtagaaaaaaagtgtttttatacaaagtaatctttctaagatgcagtctgaccatattatttccctcttgagaacttagttattccataattatctctgagtgatgtctatgacgttactttctatgccctgacttatgcctacttctctggtttcatctcttgccactctccatcccatgaacttcttgtagttccttcttactcacctcgcctatgactttggttgtgttctattttctgccaaggtcacccttccaattcctttcctctcaggatgcctaagctttaagtctaagcttaggcatcagcacctccagaaaacctttcctgattcttgcctgtgctaactgactttcctgtaccctctgtactccacaccccatgtctgatcacttactacaatatgttgaaaagatccttctggccatggatcatgctttgttcatctttataccccctaaaacctatcacgtgcttgagccatacttaggttttgatagatgtttttgaactgttgcaagcacttaggacctgtatccaaggaatgcttgaggtatagacactaaagatccctaacagaaataactactatttctgaaacatctattgtgtggtggcctccaactctgactagcactcacttagccccataccttgtcttatttttctccatggcacttatcattgtttgttatattatacttttatttattgagttgtttgtcagacttctcacactacaatatcaattccatgaaggtaggaatatttgtctttgtccactgacaatcctcaatgcttatgcagggcctggcacatagtaggttctcagtaaatattttttgaatgaatgtggtaggtatggactttcaacatataatctaatttagtcctcccaagataagtattaatgtttctgttttagaggcgaggaaaggaaagctcctcatcacctatacaaaaaaggacagaggttttgagaaacgggtgtgtatatgttgagcctatagattcaaagatgattgattcaaagatcagggtcacaagatatggggatacaacaaaaatgtgagcccaataaaaataccagttaatgagtgaatctctgccaagctgaactgaagagaaacactgtgtactctttcccccagatatttcacattctacaagtagaatcagttttgaaacttaaatagttaattttctttctgttgttcttaaagaatctgggggcttgtgaggacttccataggaaaattaggaggcaaggtcattggagcaagggtacaatttttgtagacaagccgttaaggatttacagagaaaggttagtttgtggtactgagagttaggatacctcttgtgtggcctctatagtcacaaaccatacttaccttgataagagtagatgagaaccaagcactttgcaaaagtcagagtctggagtttaaccattattatctgggagttggtcaaatctcaataaaggtgacataccctcagaatctttgaattctacctcaagttttgccttctgtagtcccctcatttcagctctggattcttctgcctcctttaagacttatttcaacgtctctgacctgactatttttagtctagatagattaggatgagaggaaaagacaggcttaggacggacaagtctgttcctagggattcttggctctttttattcctctagaggggaaatgtttcctaaaagatgacccaagaatcaagcttttttttctctgtgtcagctctccccaaaagaaaaatatctggcatctgtatcatacatcacactttattgatagcttttcacttacactaggacattttaatcatcacaatcattttataattgaggaagtggagcaaaggcatatagctaattgaaggccacacaggtagaaaatagtaaaatttgctttgtgaatcttaaatgatagcaaagcccagccaagtttagcttgatgtcaagattaccacggctaaaactcaattcatcatctttgccccccaccacctccaaaacccctctacttctctgttccttatctcaaagggtggagcccttttccacctgggagttaacattgacttttattctcatgatgtctcttgaaaatgttctctcttcaataactactctgccccactatcctatcttagaccctcaactcctctcatctgagttgatgcaatgacccttccctgcctgcattcttatacttcttcattatccacaccaaggggacatttcttttcttttcttttcttttcttttttttgagacagggtctcgctctgtcacccaggctggagtgcactggagcaatcttggctcactacaacctctgcctcccatgttcaagtgattctcatgcctcagcctcccaagcagctgaaattacaggtgcccgccatgacatccagctaatttttgtatttttagtagagacagggtttcaccatgctgattaggctggtcttgaactcctgacctcaagtgatccgcctacctcggcctcccaaagtgctgggattacaggcatgagccaccgcacccggcccagagggacatttctaaagcacaaattattaatagagcaagtcattaaaactcttcaataaatttacatcagctttaggctaaagtacaaattccttagcttggcatcacatcctccctcctgtctctctaccttccctgctatgaaccctgcactttactgattgaaacttttagtttcctgaaagggacatgaactgagctaatatttattggacacctattatgtgccaggtagtggcctaaatgtatcatatcttgtaatttaatcatcagcaactatcctacgtggtaggtgctgtcatcatccccatgtggcagatgagaaaactgagacagagagagacaaactaacttacctaaggtcatgcagtaaaataagtggtagatttgggatttgagcccagacagtctgtgttcttaactactaccctgcctctttcatttcttacaatctgccaagaatgtcctttttcccatcctactgttcaccaagcaaaacccttcaaggcttaatttgagtcttctttgggaaatgttacctgacttctccacattccttactacctctgatcctcacccatggctgaataaggtatctctcttctggcttctcctagaacctgtgcatacctctaattatagcacttgacacacagcttacatgtctgttcacgaatttcttgagagcatgaagtttgccttagttgccttttatcccaacatgtatgcagcacagtgcctggaacacaataaatccttcttgagtaactattcttctcctggaagatctcccgcaaatgattgtggtgagtttctattgtcaaaacttataaatccacaggtgacatctttcgctattctggagccatgagagcctctacaaaactaagcagagagggctcctaaataggatggtacggattgtgacctgtatttgttcatactttatttgaatatacttgcacatttacagaaaaattatgagaataagaataaaaagagtactcatacgttttttacacagactcacctattgctaacattttccccatttcctttatgatttgccactcactctatcatctgtctatctatctgtctatctatctatctatctatacacacatatagttgatttttcctgaaccaaccatttagagtacattgtatatatcatagcccttttaatcataaacacttcactattctcttacatatcctcataccattatcaccagcattaaatttaacatttacatgctactttaatataacctacactctacatttcatttatggaatattccatattccaattgtggcaataaactgtcctttatagcatttttgttctgatgattatcgactgggtaaccttaggggcagtggcttcatctctgagcttcagttttttatttgaaacatgaaggtgataatgaatgccttaataagctagatgttggaagagtaaatggtggtaatttatgtgaaagcaccctggcatatcgtagtaaggcctgttcgaccatataaatacagcatagtgggtaaacatgtgggctctgaagtcagactgcctcagttcaaacccttgtttagtcacttaccaggtgagccatgtgggcaagttaaagcatctccaggtttaaatttcttcaacatcaaatagtgacaatagtggtgtctacctcaattgttgtattaaattaggctctacatgcaaagtgcttaaaatagtgtctggctgagtaagtgctctataaatgtttaactattatcattaagtttgacaggtatttcaaggaggatccttgtattacaaaaaaactggtataatctactgtactaagacctatcggaggaataataacagtaattaacaaatcccaacttaaagattttaaaaaacttttcctgtccttcatcataagctcttggaacatattaattaactttataatattaaattcaccttgttacaaagagcttaagtgtctcacctcaggtcacgatgctgggaattaggacctagcccttcattgacttttcttcctgacagaaatcactccatatttcctctctatgtacagtgcaatagcattcttctaaatttggctttttgccatggaaatgcttgaccacaagtctcatgtttcctctcccagacaaaagacctgggacctaattaggtggtaatattcaaaatatttaaccacccttggtctcagtaggagctgggttttggaaggcccctttgtgttagtcattgtcctgtagtcgctggatcaagttgggcagtaggaggagcataaggaggaggaggttgagtggccaggaccaagggaatccatgagggacttggggcagtgattattcacaaaccattacagaagcgtgttaatatttttaactccaggtttttaatcactgtgcagagcatctcagtcctgggcctaggaaagcattcttagctaacaattccgtgtccacctctaatgctgccacagagaattcttgaattccttgagatcttcctgccagcgataattaggcagacagccaataccatagcattgcaaagagatgatttaactaagtctctaaaatcttctatcattacccttggaaaagtatatcaatgacactaataacactggtattttggtcacattgcaaaccaggtgataacctgtattcttggccttttccttaagtcatgctgttgctattacatttatactaaagccaaggtggggcttattggatacagggattacacagcttgctggagttaagctagggagtttccaattctattcttcaagtagaaggtgtcctatagtttgagaatggccaagggtaaaagtgagtctcatctcagtggctcacatttatccagcttcggctgccaagagtagatggtaccctaagtccattctgctcctctgctcttaggattaaagctcagattcaggatggtgggcaggggagatggccacagtgtggacttgggaccctgactgctgctggagaagcagcccatgtgtctttgggaagacagaggttccggtctcccatcctggaccccacaggcttcccttggccacccagggatcaggcaggactagagctgggcagccaagagacagacagagctgacccaaggcaccagagtgtcaggtgcagaagggacccgcaggctacctgccctccttggtcagcccttctctctccaggcccttaccaggctcaggctagaaaagctttcagattacctgttatcaccctctctccctgctgccaggtttccctccccagccttcctgcccagtgctccccatgtatcttccaagtgggctaggatggatctggaagctcccttcctctctctgcaggcacaggattccacttgtcagaacgttctttctgctggtgagccaagccttctccctgcctctctctcccacataattttattgatatataattcacattccatacaagtttcccatttacaatgcacaatttagttttttccatttatttacagttgcccaaccatcaccacaatcaattttagaaaattttcatgaacccaaaaagaaatcctgtacttatttgtaacccattcctccccaccacctaagccctaggcagctacttttctacttcgtgtttctattgatttttctattctggaaacgtcatataagtttgggtagcatgggtttgatccaccttctctgggaaactttgggtaagtcacttcacctctctgtgattcagtttcccaagcataaaagcagaaatattggtttctacctcatagggtcatgatgaggcttaaataagctaatgcatgtaaaacacttagcagagggtttgcttttattactgctttttataaagtgattttcctgattactgctgtcatccttaactggtgtgttctcattgggatggggtagagtaggacatgggggtgataatgcaagtatttacataatatccaatatatttaataatgcattaaagcaagtttgtccaaaccatggcccatgggctgcatgtgacccaggatggctttgaatgtggcccaaaacaaatttgtaaactttcttaaagcattaagaacttttttcgtgatttttttttttagctcatcagctatcattagtgttagtgtattttatgtgtggcccaacacaattcttctttgtccaatgtggctcagggaagccaaaagattggatacccctactgattaaagcgtggacataatccatcagaatgtgtgagcaatgatgaaagtcctgtggtatttctgttgggtctggcactaacccaccaatttctgatctatagaaaagtcaagggtccaggatattactagggtaacagaggaggaacttggagggttctcagctgctgccatatactaatcggcctggaaggattttaatattttaatactcagtatggccatgccatcatatgctggctgtacattgggcttgtgtaggactgtcatcttccttgctatggacaccacacttttggttataaaactactgcatcctcactgcttttttggcagctacaccacactgcactgaggcctggggttgaagccctcaagtcttttctattcaggttgctgctaagttccatcatcccttaataacccctactaggttgtgttttgggcctatgttcagaatcttagatttctaagtgtgattcatgttgattgttaagctccttgaattagggtgtgtactttataccagacataataaaggggcttcaaggcttccaggcaggcaggcagagctggcagtggcagcaatgacacctgtccctacatatgttctttgactcctcagaagtggaagggactctgtttagccttgcccttgaccatgaaattcgaatatgctacacattgagaaaagaggagaaggcctgagggaagagaaggagatgaaagactattaaaaaggataaaatctccaatctatatagagatgtggcaaagccataccaattctagttccaagcagttcttcaggtaaaggctgatttgaaaatagcagctaggaaggcggcttcagaagtgcaagcagaacgagcttcaggcaaagcagagacattccaggaaatttaactgaaaaggagagcaaggtgactaggaaaatgaccctgaaatgaggacagcatatgggcttctggacggatggtagtgtgtgaggtattgtagggggtggcagcaagcacaggtaaatggggtggatggaggtggtgtctggaacttgtttcctggggcccaggcaaagcaaggtatttcaaatcttgtcatagggagggttgggttttgttttttgttttttgttttttgtttgtttgtttgtttgtttgtttgttttttgctattggtctggctagcctttcaatgatacagcaagtgaggagaaaaggcagccagcgcaaacagccagggcatggctttatcagggctgagggcagacaatctgatgagccagtgtggtgatttgtgtagcctgtctagtgaggaagggagaggctttttctagctaagcagctggtattgtaactgtcccgtgggttcaccttgcctgctgcctagacagagccgatttatcaagatagagaaattgcaatagagaaaaagtaattcactcagagccagctgtgcaggagaccagagttttattattacacaaagcagtctccctgaacatttggggatcaacgtttttaagggcaacttggtgggtgggaggaagccaatgagctgggagtactgattggtcaggtcagagatgaaatcacagggagtccaagctgtcttcttgcactgagtcagttcctgggtgggggccacaagatcagatgagccagtttatcaatctgggtcgtgccagctgatccatcaagtgcagggtctgcaaaatatctccagcactgatcttaggagcaatttagggagggtcagaatcttgtagcctccagctgcgtgactcctaaaccataatttctaatcttctggctaatgttagtcctacaaaggcagtctaatccccaggcaagaaggaggtttgttttgggaaatggctgttatcatctttgttttaaactataaactaagttcctcccaaagttagttcagcctacgcccaggaatgaacaaggacagcttagtggttagaagcaagacggagtcagttaggttagatctctttcactgtctcaagcataattttgcaaaggcagtttcaatccctccctttgcgttttataacaccttgatcttaaggtgttggctaatgaagatggaaaaagagcaaagactactctaacttcttccttctgatcaggggtgtagtggaggtaggtgttgaccccaaggtgagaggattaggaccactttgccactgtctgagcacactcatgcaggcctggctggggttccaaggcttgcatcgtgaaggtgttagtattgtcatctatagttttagtactgcatttaagggaacagcatactataaggtaaataatgtgtactagggtaaggagtgcaattcccagttttaaaagtaaagatctgaaagcattagtttggggacttgtagcccacaaagaatttaggatttagtccaaactgcagaaaaaactcaagaacagctaacaagaggtgtactatagtttttcttttgaagcataatttttctctctctagtcctcatttttattaaaaacaaatcatgatagaattgatttgtttataaaataaactttagtcttattgtacttggcctgattatttgcataaagtacagcaagaataattatttttcacatagacttttaaaattggctttgatggaactctgttccgtaaggaatctcatataaagcttttttaaagctgagcccagccatgggtttgtaccctcaaatacctatgatttgggtaaattcccttccttttgaggtcccaagataacttggggctcctgggcctctcagaaagtgacattctttacttaccacaggtcaggaaccttgtacagggactgtgtagacaaggtatgaggccagattccccaaggggttattactggctctgtaagtcaactttgattttttttttttttttttgagatggagtttcactctcgttgccctggctggagtgcaatggcatgatctcagctcactgcaacctccgcctcccaggttcaagcaattcttctgcctcagcctcccgagtagctgggattacaggcatgcaccaccacgcctggctaattttgtatttttagtagaggcagggtttctctatgtaggtcaggctggtctcgaacccctgacctcaggtgatccgcccacctcagcctcctaaagtgctgggattacaggcgtgagccaccatgcccagccaactttgattctttaaagaaagcataccattccaatgaaagccttggtaaaataaccagtttctccaaatgtgtctgttacaaaagaaaacagatttttattgcacgtatgcaaataactatactgccataagttgagaatactcataaatagtttccaaattttggagaaatcaggtagagggaaacaaatatgctccaaattttgtttgcaggagtacattttactcaattgttaaaagctgtaaatagttcaaaagaaaagccttcttgactctggaaaacataaaaggattagcaatgttttaagtgaaaagtcaaaaaagattacttcagccttctatttgaaagtgtttcctctattgtaatgtgacgatttccagagttatcaatcagaaacttgcatttaagagcacctgatagagtttcatagctgattataaaaccatcatttaggctgggtgtggtggctcacgcctgtaatcccaacactttgggaggccgaggtgggcagatcacgaggtcaagagattgagaccatcctggccaacatggtgaaaccccgtctccactaaaaatacaaaaaaaatagctgggcttggtggcatgcacctgtagtcccagctactcgggaggctgaggcaggagaatcgcttgaacccaagaggcggaggttgcagtgagccgagatcctaccactgcactccagcctaggcaacagagcaagactctgtctcaaagtaaaataaaataaaataaaaccatcatttaaacaggatcaaaacaagacaagaattgtctgtggatgacaaaaagattagggcagccacagttaaagacaattgacaaggaaatttgttacctccgtggcacacaataatttaacataacaattataattattactgataatatacactaagtcatatcagaattataggagtttcacataattttggaacatataacaataacacatttacacaaatatagcccacagaaagtcaagcaccatttcatatttggcaatgcttcctgtatgatttttatatcaaataagccaaatgtgtcatttttggacttcagagggcctaatgtctagaggattaattaggtcagaaaatcacatactttataactaagctgatttttgaaagtctgtcaaatatcaaaggtttaaaacactggatctcacaaaataggatcacagcttatttatttatactaagcggtaactcaaaaaaaatttttttaaaggcaaaaatctttactctgatagaagagacttagctttccaaacaagacccaatgaagataacaagaggccaactgaatttgtttcttttctgtccttttttccccctcccacttacccaaaggggcaaacaaaaacctttcattatattacataaaaatcttttccaaaaaaccaaacttcatgtttgcatgagtacatctttcatgctaaagctggtttttacataaaattttataaatctatccagttttaattaatttgactataaggtaagattttcacaaatgttttagaaccctttataattttccattaaatagtccattaatgttctaagaaaaccctgttattcagacacataggcccagattctgaccccaaatcattatgattttaatgttttaacctacaggaaaaaaattaaataatccccttcaaatcttagccaatttgctcataaccacagagctttctttacaagaccaacccttcacaaacccttttcactttgcttaaaccttcagttttgtctcattactcttttaggttaagataatctttaaaaccctatgaactatacaaaattacattcccattaaaagaagccatattcccatgccttctcataatcttttaccaaaaactcattctactttccttacataccttgtatgtaaaactgtttctccagtagtctcaataacctgttacaatgttaactcttagcaacttttacttttggtgaaaaacctaagaagcaattttaattatgtactaagggtggaacctaggacattatacagaagtgaagataaggtatgactctttctagcataggtagtgggagcatggctaactccacatgtccccaggccttatctagaatctaatgctccaaagtagataaattgaacaattttcaaaagtcaaagaagcagtttatgatcttaaagcatttagcacaactgatatctgaccttaatttagaccaaatgtctatgttttgaagacattttattttaccaataatctttaaaactgtctttatttccaaaagattactaaagtcatgtgaacaaaatagcattacagtttatttttatttttattcattttttttttttttgagatggagtttcactgttgttgcccaggctggagtgcaatggtgcggcttggctcaatgcaacctccacctcctgggttcaggcaattctcctgcctcagcctcctgagcagctgggattacaggcatgtgccaccacacccagataattttgtatttttagtagagatgaggtttctccatattggtcaggttggtctcaaacccccaacctcaggtgatccacctgcctcggcctcccaaagtgctgggattacaggtgtgagccaccatgcccagccctaaagtttctatttttataacaaaatatttgacttaagtgcttattttcctaagccaattaattagagctcttttatataaacatcacacacataacacatacaaatagacagacagaagatccagtagttgtaagatttttcatttgccagattctttattggattacaggcttcaaggtggagcccttggagaaacagggccaggaaaccatgcagtttctagggcctaataaagagacacagatgaaaggcaaagatagatccccaaaattaagggtgccattttatactggatcctggatccccaaaaaggagggaaaactatgggagaagacagtgcagtgcttctaccgtgcctttcattgcaaggcaacccaaagccaaccagcccattttgtaatcagttcatcccccatgggagtctcatctcttagtgggggtttgggatgtttccatctattccaggtggccaaaagcatgcttctctaatcgaaacatcaaagagccaagtatccccccataactgccattaaccatcctcaaaagtgtatttcctacctagttattacacaccaagcttctttcataatgcaaagtaatttctgacacccacaaaggtcaaaaccatcaactaaggcaatgcaaaacagaacagaaccttatattttgagagggatctattctctttcacttcctgggcttctgtgaggaaaacagaggtttttcccagaatggtctctgtggtgcctcctctgcttttccccaggagtctcaggctgttagaattatcttagaaccttatattttgagagggatctattctctttcacctcctgggcttctgtgaggaaaacagaggtttttcccggaatggtctctgtggtgcctcctctgcttttctccaggagtctcaggctgttagagttatcttaggttctccacttttacactgctggtgggactgtaaactagttcaaccattgtggaagacagtgtagcgattcctcaaggatctagaactagaaataccatttgacccagccatcccattactgggtatatacccaaaggattataaatcatgctgctataaagacacatgcacacatgtgtttattgcggcactattcacaatagcaaagacttggaaccaacccaaatgtccatcagtgatagactggattaagaaaatgtggcacatatacaccatggaatactatgcagccataaaaaaggatgagatcatgtcctttgtagggacatggatgaagctggaaaccatcattctcagcaaactatcgcaaggacaaaaaaccaaacactgcatgttctcactcataggtgggaattaaacaatgagaacacttggacacaggaagggggacatcacacaccggggcctgttgtggggttggggtggggggagggatagcattaggagatatacctaatgtaaatgatgagttaatgggtgcagcacacaaacatggcacatgtatacatatgtaacaaacctgcacgttgtgcacatgtaccctagaacttaaagtataataaaaaaattttaaaaaaaagaattatcttaggttctttcatgtaggcatcaagagtggcaagaagacaaaatggagaataacaattcagtctaccaagaagaataaaactttttttcggaaaaacgcaatccaagaagaggaaaaagataaagtccttttaaatacatatagcttgtatatacattcctttttttgtggggaaatggagtcttgctctgtcacccaggatggagtgcagtggtgtgatctcggctcactgcaacctccgtctccaaggttcaagcgattctcatgctgcagcctcccaagtagctgggattacaggcatgtgccagcacgcatggctaatttttgtatttttagtagagatggggtttcaccatgttggccaggctggtctcgaactcctgacctcaagtgatccgcccgcctcgacctcccaaagtgctgagattacaggcatgagccaccgcacccagccacatatccgtttttaattaagaagattttaaccacagagctccttttgtaaaaaaaaaaaaaaaaattaaaatattttattgccagactctagccaggacagtcagtcaatatttctggcttttgaactttactgcaggcaacctcccatgtgaaattaataaattttaactaaggttatgacttaaccacggacacatacggtgtctcaaaggaatggtaagcagttttttgtttttttgtttgtttgtttttaccaagacaagaacagaagaacagaagctatcgatgggttaataaaaaaccctcaataaatggcaaagttacacacataacaaaccagaaatgaattattccagaagccaagaattgaatccaggctgccattgtcaaaaagacaaaggcttagctactgagttatacagcattgagcagtttccattgcttttcccagaagaagtctagagcagctaatttcaagcttgcaaaggcttttaactgctcaagataatttttagggctatgacatgaacccccaaattcctgtcctctggattgcagaaaccaagagaaagtatccccacatggtcacaaggttaagctcttaaggatacaaaacaagacagagatatttcatcctgtattcgtttcaggaacccattgcaaagttttaaccaaccagcctgctgggctggcttgaaaagccacccttttctgttttatggaaccataggcaaaagattgtcaattttgcaagatgttgcccaacaggctgcatgggtaaccgaattaacattttccagcccaacaaaatacacgtaacagaacagacactagtcacctcattcagcacccaatatcaacctggcaaagttcggactttcttctgttggtccctgttgtctttgatccactccaggtggggagggctgacttccaaataataattcacaatgggtgatctttgggcaaggcaaagaccagatagtcaccctgagacaagcctgttgagctttttttagggcttaccgaatggaatgtgaccagacaaataagggggttctctgagttaggcctgctggacttccgtcagcaattccttctgagatcccctccacatatacaaatgcacacaaagacaagacagacagaaggccttccaaatcagatccttaaccaagaactccaagaatatcccttccaaactaccctccccttctctgtctgagaaatctcccccaaattttcctgattgagaagtctcctgaaccaagattcttcctactagttagggaaagccaaccgagaccctccaggagccgaaccaagacagacaccacccaatggagctacagacaaactgagacccctgaaggagccaaaccgagacagacatcctgaggtggagctgcaaacagacaccccacaatggggctaccaacaccccaccatagggctacagagccagtcaggagaaggaaggaggcattggcaatgcctaggatactcaccaacccagataccctgcaatggggctacagaccgacaccctctaatggggctacagttatgggattccttcccaggactatttctccattgcaattaaatccaatgcacattgggtcagcagcaccagatagagcataagtagagaaccagagtcagaccccagtccaagagaactaggtggccacttgggctggcctctggatccatcgccaggtggatggcgatgaaccatgggcaggtagccacaagggcaatcccagacgagctcccaaatttgtaaccgcccagtgggttcaccttgcccactgcctagacagagccaatttatcaagacagggaaattgcaatagagaaaaagtaattcactcagagccagctgtgcaggagactggaatttgatcattactcaaaccagtctggagcatattactcaaatccagagcattcagggatcagactttttaaggacaacttggtgggtgggggaagccagtgagctgggagtactgattggtcaggtcagagatgaaatcatagagagtccaagctgtcttcttgtgctgagtcagttcctgggtgggggcctcaagatcagaagagccagtttatcaatctgggtgttgccagctgatctgatccatcaagtgcagggtctgcaaaatatctcaagcactgatcttaggagcagtttagagggggtcggaatcttgtagcctccagctgcacgactcctaaatcataatttctaatcttgtggttaatgctagtcctacagaggcagtctagtccccaggcaagaaggtttgttttgggaaatggctgttatcatctttgttttaaactataaactattataaactgtaaactaagttcctcccaaagttagttcagcctacacccaggaatgaccaaggacagtttggaggttagaagcaagatgaagttggttaggttggatctctttcactatctctagtcataattttgcaaaggtggtttcagtatgcagaggaagataaatgctggcatctgggcacctgatgaaagaaaagtatgtcctcagaaaggcaatggagcagttcggaaaaagaaggaaaagggtagaactgcagcttctgtttttgctcaactctggcagctgagtgttgtgggtggggtactggaattcaagagaccctaaaatgctctctgcagacctcagagctgatgcccactgatgatgattccaatcacaaaatctcaaacactgtgctatgagtacttgctaatgaaaaccctgtgctgtctagcagggcaagggtgtgtttcttaggtaaaacttccaagtatagttgggatatttttctctagaatgtcttcctgtccccaaggctaggtctctctttgactttatctgggttcataatgttgtgactaagagcagatactttctctgtctgagttccaattctacccctgctacttactagctgtgtcatcctaggcaagttgcatcaccactctgtgactcagtttcctcatctgtagaatggctatagtgagagcacctgcctcattgcattttttttgaggcagagttttgctctgtcacccagactaaagtgcagtgttgcaatcacagctcactgcagccttgacctcctgggctcaagtgatcctcccacctcagcctcccgaatagctaggaccagaggtgcacgccactacacctagctaatatttatttatttatttatttatttatttatatatttttgagatggagtctcgctctgttgcctaggctggagtgcaatgtcgtgatcttgactcactgcaacctctgcctcctgggttcaagcaattctcctgcctcagcctcccaagtagctgggactacaggcatgcaccaccatgcccggctaattttttgagtttttagtagagacggagtttcaccatgttggccaggctagtctctaactcttggcctcaagtgatccacctgcctcggcctcccaaagtgctgggattacaggcgtgaaccaccacacctggccattttttaaatttttagtagagatggggtttcgccctgttgcccaagctggtcttgaacttctgggctcaagcaatccactcgcctcagcctcccatagtgctgggattacaggtgtgagccactgcacccgtcctcattgcattatttataaggaatcataacacaggtcaaatgcttagaacagagtttagcatgtactaagaacgcaataaacattataacttgggttttgagtcattctccaccttagtcattgcccttcctgctttgtgtcttctgtaaatgtccctaatcaagccactgaataaaaataatgttggcatgaaaagaaatctctcttcctttcttaccagcctcccattcagttctctgagctgtctgaacacttcgggcacatacatgtatatgcactgtggctattaaggtctcaccccttaactctgctgcactcagacgatccaaactatactcaggggttttacctgagaaacacccccttgccctgctattcagtacaggattttcattaactagtattcacagcagtgtttgagagagattttgtgattggaatcagcatcagtgagcatcacctctgaggtctgcaaagagtgtcttaaggtctcctgaataccagcaccccccacaacactcaactaccagagttgagcaaaaacggaagctgcaactctgcccttttccttctctttctgaggaccactcctcacatccttttctctccttgtattactacacttcttcccccaggatgctgctccttctatcttttctccctccctctctaccttcttctctctctatctgcaccgcctacccatcatccagtcatataagctgggtacctagagtaatcatcctagatcagggatcagcaaatatttttccataaagagtcagacagtaaatatttaaggctttgagggccacatataatctctgtcacaactactcaattctgctgttgtggcacaaaaacagccatagccaacatgtaaatgaatggatgtggctgtgttataataaaactcttgtgcaaacacaggcagtgggccagtttggcctgcaggctgtagtttgataagaattattgcaaggcataactttttcctcaaaacccattctgtcatctagttcataaaaatatgttcaatttgtccacttcttgccaactctgctacttccaccatggatcaagccactgtcatctcatgcctggaccgttcattgcagtagcttcctgattggtttctttcactctacttttgtcctacagttcacatagcagccgaagtgttcctttcaaagttaacatttcatttctatttaaaaccattcaacggcttcatacttttcttaagataaagactcaaatctttatatggtttatacgatactacatgatctgagtatgcctacttttttcagtctttccttttaccaccctttcttgatgactatgccttagccacacgggcctttatttagttcttcaaacatgccaagcacttttatacttcagggcctttgcataaactgttccctgtactaaaaatctgcccccttccccatctcttcatttccattaatccacatggaatgaatgcctattcatctatcaatcctcaattcaaaggacatttgcttaggaaagccttccctactcagtcccagactagaagacgccccacagaaatatgctttcagagctccacataatttttcttccgagaacatatcccaatttataatatgcagtggttcatgtgattatttgattaaagcctatttcccctactaggatgtaagctccatgatagcagagactgggtctatcttctaccttgttattaacatagacccaaaatctttaataaaactgatttgtattaagtttaattttcaaaaatattttgttggggtataattggtatataataagcaacacattaaaaatgtacaatttaataattcggacatatatacatatatacatacagttggtactctgtatctgtgggttccacatccaaaaattcaactgacttcaaattaaatatattcaaaagaataaactttaaaagttacaatacttttaaaacaataaaaataatgcaaataaaaaataaagtataacaaccatttacatagcatttaccttgtattaggtattacaagtaatttagaaatgatttaaagtatgtgggaggatgtgcataggttatatgcaaatattatgccattttatgtaagggacttgagcatctgtggacttggtatttatgggagatcctggaaccaatattctgtggataccaggcgatgactctctctttctctctctctcttatgtgtgtgtgtatatacatatacacatatatacacatatgtatatatacacatgtgtgtctgtatatgtatatataacatcatcataatcaacataacgattatgtccatcaccccccaaaatttcctcatgtcacaatagatcagtttgcattttcaggttttggggtttgtttttgcaactgggaagttattttcattgttttcatttctttctcttccaatttaaccacctcctctcctctcttttttttttgtggtaaaatatatatagcataaaatttgccattttaattattttaagtgccatttaattaattcagtggcattaattgtattcacagtgttgtacaatcatcatcactatctatttccaaaacattcttatcaacccaagtaggtactctgtaagcattaagcaattaactccccattctcccgcaccccagatgctggtaactactaatttactttctatctctgtgaatttgccttttgtagatatttcacataagtgggatcataaaatatttgtcctttgtgtcaggcttatttcactcagcatagcgttttcagtgtgcacccatgttgaagcatgtatcagaacttcattcctttttcactgctgaatactattctatcatatgtatatactacattttgtttatttattcatatgctgatggacactggggttgcttccaccttttttttttttttttttgagacagagtcttgctctgtcacccaggctggagtgcagtggcactatctcagctcactgcaacttccacctcctgggttcaagagattctcctgcctcagcctcccaagtagctgggattacaggcacatgccaccactcccggctaacttttgtatttttactagagacagggtttcgtcatgttggccaggctggtctcgaactcctgacctcaggtaatctgctcgcgttggcctcccaaaatgctgggattacaggcatgagccactacgcccgaccatttccaccttttgactattgtgaataatgctgcagtgaatagtagtgtataagtatctgtttgaaaactattttcaattcttttggatatatatctagaaatagaattactgggtcacatggtaattctacgtttagatgtttgaggaagcatcaaactatcttatacagtaattgaaccatttcacattcccaccagcaatgtatgagagttccaatttatccgcatctttgccaacactgaatattttccattttcttaaattacagtcatcctagtaggtataaagaggcatctcattgtgactttcatttgcattttcctaatgactaatgatattgaacatttttatatgtttgttgccatttatatatcttctttgaggaaatatctactcaagtccttctcacatttttaaattgggttgtttatgttgttaagttgtaggttttctttgtatattctgaatatcaaacacttctcagatatatgattttcaaatattttctctcatcctgtaggttgtctttttcctttttttttttttcgagatggagtctcactctgtcacccaggctggagggcaatggtgcaatcttggctcactgcaacctctgcctcctgggctcaagcgattctcctgcctcagcctcctgagtagctgggattacagggatgcaccaccgtgcccagttaatttttgtatttttagtagagacagggtttcaccatgttgcccaggctgattttgaactcctgaccaaaggtgatccacctgcctcggcctcccaaaatgctgggattacaggtgtgagccaccgtgcccggctttactttcttaataacaccctttaatgcacaaaagttttaaattttgaggaaatccaatttagtaattttttcttttgctgctcatgcttttggtggcatatctaagaatccattaccaaatctgaggttatgaagatttacttccatgttttaagtattttatgattttttactcttgtatttaagtcattgatcagttttgagttaatttttgtacatggtttgaggtaggagtgcaaagcccttttcttcgcatgtagaaatctagttgtcccaacaccatgtactgaagagactatttatttccccattgaataggcttgacaaccttgtcaaaaatcaactgggtatagatgtataggtttatttatgggctctcaattctattccattgatctatatttctctcattatgccagtagcacactgttttgattactgtagccttttaggcagatttgaagtctggaatgtgagtcctccaactttgttcttttagaagattattttggctattcagggcccttgcagctccatatgaatttgaggatatgctttcccatttttgtaaagaaaaggggagctgttggaattttggtagatactgtgttgaatctgtaagtctctttgggtagtactggcatcataaaaatattaagtcttcttacccatgaatatgagatgtctttccatttatttaagtctttaatttctttcagccatgttttataattttcactgcacaagtctttcacctgcttggttaaatttattcctaggtattttattcttttagatgctactgtaagtgaaattgccttcttaatttctttttcagattgtccattgcaggtatatagaaacataactgattttttctgtgtttgtcctgtacctggcagctttgctgaattctttaattagctttattagctgtcttctggtttccttggcactttatatacattggatcatattatctccaagtagagatagttttacttatttcttttcaatttagatgccctgaatttctttttcttgtttaatttatctggctagaattttcaatacaatgttgaatagcagtagtgggagtgggtatctttgtcttgttcctgattttaaagggaaagttttcagtttctcacaattcagtatggaattcattatgggtttgtgtaaatgccctgtaacatgttgaggaagttctcttctattcctagttctgagagtttttttttatcataaaagagtattggattttgcaaatgctttctctgcatcattggagacgatcatgtggatttttctcccatctattaatgtgttttattacattgattgatttttctctacattgtgccactcttgcattcctgggataaataagtttaggtagtttgtgtgtttcaaataatttatctatttcatctaggttattaaatactttggtgtacaattgttcatagtattcttttataatccatttttatttctgtaagattagtagtaatgtccccacttgattattttatttatttatgtcttctctctttttctccatcagataggtaaatatttgttaattttattgacctttttaaagaactaactttgggtttcattgattctctctttttgtttttctattctctgttttctttttctccactctagtcttatttccttccttctgttagcttttgttttagttttctcttctttctctagttcttcaaggcataaagttaggttactgatttgagatattctttcttttttagtgtaagcatttacagctataaattttcctctaggcactgccttttctgcatcccataagttttggtatgttgtgtgtgttcactgaagtgtctgctccctagcttatattcagctactagtgttttgacagcgatttccttgaatgtccatagctcaaaataaacaaacaaataaagaaatacctttcgcaatctttgcagactggctaatgatcagcccaggctgaaagcttaggggcatctcagctcttttctgagcatgtgcctctccctaggcatgcatgtggccttcttaattcttctgtatgagtggcacttttgaatgtttgaatttcccaaagaaactctccccagcttttattctcaggccgtgggcaatctaatatatatatatatatatatatatatatatatatatatatatatatatatatattatatataaaatatatataataaatatataatatatataataaatatataatatatatatatttagagacaggatctcactctgtcacccaggctggagtgcagtagctcactggatccttgaactcctggactcaagtgattctcaagtgattctcctgcctcaccctcccgagtagctgaatctacaggtgcacaccaccacacccagctatttattttttattttttgcagagatggaggtctcactgtgttgctcagagtggtcttgaactcctgggttcaagcaatcctcccacctccacttctcaaagtgctagggttacaagtgtgagtcactgtgcctgactaattgtaaattttaaaagtaatattttggctgaggcatctgtgggttgccagttcaactttcagtgttttcaagcaatgagaaatgctttttcagcctgaatttcaagccaggtgaaacagagatgagcaccttgtgtctatccttcaggtagcccctagacaggttagaatagacatactcagtagtttggaaataagatctctgcttctctttctggaaccagggaccaagatcctatactgggaatgcgagctaagactactgccgcacagaggagaaggtgagggaagggcaagtaaaagtgccacagagcttccctaccactttgaagttgcatttttcataattaagcattcacttgattggttgttgtaaacccttaattgttttacagaattctgataaactggttcttctttttttaaaaattagtatttttgggtacatagtagatgtatacatttatggggtacatgagatattttaatataggcatacaatgcgtaataatcattgttataatttggacatttgtccccacccaagcctcatgttgaattataattcccagtgtaggaggtggggcctggtggaaggtgattggatcatgggggcagatccctcacggcttggtgctctcctcgctatagtgagtgagttcttgtgagatctggtcctttaaaagtgtgtggcacctctcccccgctccctcaaccccaccactctctcactcttgcttctgcttttgccatgtgatgtgcctgttcctgcttcaccttctgccatgagtataagctccctgaggcctccccagaagccacgtgatgccagtgccatgattttacagcctgcagaacagtgaatcaattaaatctctttttaaaataaattacccagtcacaaatatttctttataacaatgcaagaatggcctaaaacagtcacatcagggtaaatgtggtatccatcacctcaagtatttatcttttccttgtgttacaaacgatcccattatactcttttagttatcttaaagtgtataataaattattgttgactgtagtcaccctattgattctgataatatttgctttctttatgatgtttttgttaaaggacagaacttctgtaagccgtctaggtgattctgatgcaagatcttgtttgagaacctctggtctgacctgcaatatggcctataacctgtggctcattttcctaatgccgtagctagaaactttgtggcaatatctggcagcactgtatcaggattctttgagaaatccagaacaggtgtccagtagtgagttgacctccactcgtgtctccctttcctactgctcccaagtggagaagacagtcatgtcactcaccagtggctccacagcccttatactagtggacttttacctaggtgaatcaatatctgagtaaataaagccagaccagctatggctggacacagatcttggcttaaccccattctacagagacagggttgctggtcataacagccatataaaaggccatagaccccgaattcagagattgaaagaaattcaagtaattctcaaataaatgatgctctggggaaatggagacacctgagtttccaagtagaagaagcttggataattgttctgtttgtaaatgtgcagggtgagggcaaactagggaatttgttctgaagcttttgcatagcaagcatactattttgaattaggttgtatgcttttctggggactttgagggtgactaatggagatcataaggaatttaaagtcccaatcctgccctaatgccaacccaggtgtttctcccctagctggccctaaattctcttggccaataatgacaaatcatgcagaaatggactcgattgggttgaggaaagaactggcctgatgagacagcaaaaatctccagcctcactgtctagggtcagagttctcctatataaaagttagagatgaaaagtctaaactggagtcaccagacttgaaatcgtgtacactcagacccctgcactcacgtggttccctaagagaccacatgccacaccccacacacatgctttgagctgagacacagcattattctactctaaaacaacaacaacaaagcatttatttccaaaaaagggacaaggtcacgagaaaaggcctataataattaactaactcaatggaaaactcatttttaaaataccccccatggagttttaggacaaaacaacagcttagtgaatgtttggttacagtttatagctatttctttcgcccttgatacactactgtgatttttcagctttctctgccaatcttgctcagcactagtggttctaagattaaagtccaggtatgtaaatggaatagccctatttgcagccttggtatgtgggctcttctgagcctagtggccccttttgttcatttttgtcagttgttagcctggcaaagggagtaggaactataccagttagaaaagtagagcctatatcaaacgttcaatagatgaaatttaatagagaaaacatgttgggagggctgaaaggccaaagaagagaaagcgaggcaagtcagagatcaacaatagtagaaacctgcttactaccactagggctgcaagaagacaggaaagaggtagtgttactatagctcaggtgccaagttcattgcagagactgccaggtaaaagctataacaatggagggaaagtttgtcatcagaaactagaacttaggagtagacccagccacagctagagatgccacttgaattagacgacactgctggataccttttgattttgaccaagcagcatccattctcacttcttgtgatacctacgccatgattttcctttccagggaactcttcctaacccattgggtacagttttagtagtactgtcaatcagggtgctatgtccaaccctagccaaggcatgggtgggcatataatataaagtatgtcaaacacaccctctctcaggaatttgaatcttgagaataaggacagaaaaatgttggaactgtttcagccatactgtggtaccttgaaaagaccatgcctcttttcctatatacctagatccccagagacactctagtttgtattttatccctcctcaagtctttatcaatttagcccaagttttcgtaagtctgaaaagtttgaactacaatgtttgccatgcccccatacaccaagtccttgtttacaatcctcagaatgcccttatatgcctctgtggccttaagagtgtctactcatcattcaataaccaacccagatataacttctgtgaaatctttcccagtccctaccctctcaagaaaagtttagcacttatctcctctagtttcccatgacactctatacatatttccgtttcagtacttatcatattgaattattttatgtttacttgtctgtctcccttctagactgtgaggttaagggcaggaccatgtcttattttaactgaggattctcagtacctagctgcttggcacatagtaaatgcttattaaaacatttgtatgaatgtatgaataaataaatggataatatagccagcatatctccattcaattatagtacaagccagagttctttctttctttgcatttaaaagggtttggagctccttaagggtttaaaggggagaaatgagtccaatatatgctcccaataagaagagatataaagagatatttttataaagacaggagacagaaatgacagaaggacattatggggaggagacagagagaatgtgaagagggcagtaaggagtaacagccaattacaaggctgtacaggaaataccatttggggcatagagatatgcagagaggtcttagtattccacttgagatgatggccaatatactccctagagacttgagggagacaagtccaatggtatgctggtaaatatttaacaaccagctctctggggaaaaggactgtaatttgtggcatttgtcattttccttcttgtaaatactaccaccatggccaatttcaagctctccatgtggcatcactgaatgcagagttgagaagagatgcaagccatcatataggatttccgccatatagataaaaacagatacaaataacttcaaaatcatagataacagtaaatgtagtaaaataattaataaatgatgagtgggtatttattctctttgattataagtttatataatttaatttggaataatggttgtatttaatagcctccttgcgatcttcctgaaaatataactatcagcttttatgagcaggtgtgggccagtagcataccactgcaggtagctctatctgtggactacttggtgactcagatgcagcctgaatagctataacaaagtgagataaggattgctggtcaactgtagctgtaatatgatcaagaggatctaggcctactaggtgatttcatggttcccaggagaaaaactctacctggtagcctcaagcactagatggccccaaaacagaatgcctgtgattcattgtgttatcttccttaatgctaaaaattatcttcataattcactttgaactggtgagataaacgacttgttctgttaagagctggatatccctggaccaaggtggtctttatagagctatgttgagagccatactgtctgatatttgtgcaatcaacaatttaaccttctttataaagtgtccagtttctaaatagtaaatactcttttttttttttttttttttttgagatggagtctcgctctgtctcccagtctggagtacagtggcacaatctcggctcactgcaacctctgcctcccgggttcaagcgattctcctgtctcagcctcccgagtagttgggattacaggtgcaaagccaccacaccgggctaatttttgtatttttagtagagtcagggtttcgccatgttggccaggcaggtcttgaactcctgacctcaggtgatccactcacctcggcctcccaaattgctgggattacagacatgagccactgtgaccagcctaaatactcttcttttaatcaaatagagaaaatggacactggttctgatttgatgcatacaagaaaaaggtggtagcaattacgatctgccagaaaagtctcacctttgcaaactcaagttgtctttgtggtgaattgggcatattactagttcctcatttcaacattatatttttgatcttccttaattttgggttccatcctcacaggacatttttagtactgaaaagaacaaaaaggaaatacagctcaatacctggtattgtaattataaatgcacctactacatgctaagcatgctattatacatcatctcatttaatcctgaaaacaaaaaccaactggtgggcactatcatttccccatcctataaatgaggaagttgcaaatcaggaaggccaagtaccttgcccaagatcacacagcttatgagaggagagctgagatttgaagccagatttgtctgaaacccaagtctcccaggcttttgcactacaccatgctgcttgaagagccctctccatttcaggaggctagtcttggagaatgggtggtctgtgcacaatatcaaaggataaatagaaaggcatgtgtctttctggagagtcacatgggaattctgaattcagggccataagatttaaaagcacaattcagtaccccacctccttatatcaaacatatggccaatcttaagagaactttaaacaaatatctccctttaaaagctgatactttagggcaactttgaagcaagccattggatacaattagatatctttgtttcctttcttttatccttaattccctttccttgccatattttggaaaggaatgcctttcctggcaggctagcctgcacttcttgctcagcctcaaaatctcttcagccttcatctctgctgtcagatagaaatttcctttctattttgtctctccctctcatagcctgaaagaacacgttaagtggaggcaaggaggtaaaggagagaaaggtgatttctctcctctaacatttcttccttcttcccttccatgagtaaaagaaaaaatgccccacttattaggtttactccagtcatacaaagttttatagccgttttgccgggacagtttttccttgtgtgtgtgtatttccacccccgcttccctattagagttcacttcgcattccatccttccacaagagtgcctcaagcagggagttgcttacatacattgctgaggttactgctaaatttcttagctagttccccctagaaacaactgacatatttacaaactgctctagaaaattgaaagagaccatatgtattccatctgaactaaataattcgaataaaatttgaactgaaaattaaaccagttttattacaaggccccttctatcttcctttttattagtgtcctcttctcttcccagcatctccctttctctgttgctaggtgttcttccccctgcagctctgtcaggagcccaagagcccctacccctaaccccacctcgacattaaaacaaaactggctggaagcgtgtagaccagtggtcagtgattctcaactctgattgcatgatggaatcatctggggacttaggaaaatcaattgtctatggtggagcctggatatcagtattgtttcaaagcatcctaaatgatgactataatcctatggtctggcctgtctttcccaccccaactttttccctacaaaaatttgttctaatctatcaattacttgggaaaagatctaatcaattcacctgcaaaacgacattgaaaactggcagaagcttaatgtgctagtgtgtcagtgggattttcattttgattataaatttttttttaaaaaactctcacagcagaaattcaggcatgcagggatatttttgggttggaggtttcccagtccccagtccatattatataggttagtattttccatgcttttgatacacacacacacacacatacacacacacacacaaatatccattacaagctttaagaacaagtaaactgacttttaaaaatcaatgataataattttattataatgatgacaataatttctttgcaatatttcaccatgacacctatatctagataaataatgactgagttataggttagatttgatatccctttgggttcttttcttagctgtattttcactaaaaaagaaaattttgatccatgaatttaagttgttgggaatggcagtgagtatttggtggctttgacagacagttttggatatttatatttgaatggaacattaacctagaaattatagaatgatttctcactaaagactactttcaatacttcattagacaggaaaataataagcatttcacaattaaaagctgaaaggtttaaatgtttcaacttggaagatgaatctaattatttctttgattacatatagctctgaaaggtgtttttttcacattttgttacagcatgtggatgaagttttttaaaaatgccaaattatcttattcattaagggaagataatcatcaaatcaaaactattgctgattaaaccatttgtatcacatttaagtaatccaaagaaatcctgatatcataacatttaatatttaagccctgaagtgataagctcaggctgttgaaaatacagaatgtattgccaagttatacctcttgaacaattcaattgaaatcatacagataatcttttctggtgttatcactgttgtgaagaaatgctttatgcttcacccttcaaaaaacttgggagaatatctttctccttgatagctctcataaatcagtgtgaaaaaatagatctgtcctatgctatccatttcttcacttagcatcatgaaaagatgaacatttgataggagatacattgtcataactccaatattgattcttttcttcaacactgaatcaaagccatgagagatattatcaaccactaatgtttctttgaccacaactaagtatgaattgacattcagacacaacttctttattcatgtggctgcagcatccttccttattgtgtgcatagctgctgctttgtcaatattaatttcagcctgattttttccagtcttgattcacatatcacaaaatgatctttaagatagtaaatattatcttctcttgaaggattgtttttgaatgatacatggaataaatgttcactagcatttctgttgcatatgtgtatcagatatgtcaattgaaaatatcccatagcatgttcacattcatgtattgttctttaattcaataatattatccaacatatgatagtgataaaggaattgtgccaaaaattcattctgaactttttctgaatataatagtagccataaactctttcattagcgttataaattcttggaaatactgttagaactagtgcatatactctaagcagtgaaattttggttgatgccattgtagtttgggcctgttatctccctttagtaataatatgcatcaatgtagtatggaaaaccattatttctgctttttctggaaacatttgactgattaccagagaggtccctgtgctttgtatgaaaatgttgtgaaagctattgtggcatcgctggataaagttttacaacagacataatctccacccaataaaagtcagtgtttagatattcattgttttaatttctccttaatttctgaggcattttaaattttttatattaaatcataatatttgcatatttaccggtcccaatgcatatatcttcatattctatatttaccccaaattcaagttcactatgtttttaatgttacctttagttactactgattttcataactgcatttgtacttgaatgaaccacttttgagccattgatacatttgggaaattagggataaaatggaaaacatagtaaccatgaaacatgaaaaattaagaatataaccaatgacaagagcaaatgttacaacatgaacaacaacttgttagctaaatgttaccccagatgaaccaatcatatccataacctcacatacttatcattactttgtggtgagaacatttaaaatctactctttttgcaatttgaaatatacattattattaaatatagtcatgctgtgcaatagatcactagaacttattccttttgtgtaactgaactttgtaccctttgatttgcatttcccttttccctgtctatcccccacccccagcctctgataatcaccattctactctctacttctatgagtttgactttttaaaattccacatatgagtgagatcatgtggtatttgtctttctgtggctggctgatttcacttagcataatatcctctggattcattcattttgttgcaaatgacaggatttcctttttaaaaaaggctttagtatttaattatatacatataccacattttcttttgtaaaagttttcaattttaatttttgttagtagtaggtgtatatatttatggggaacatgagatgtttggattcaagcatgcaatgtaaaataatcacatcatggagaatggggtattcattccttcaagcatttttttttgtagagatagggtctccctatgttgcccatgctagtctcaaactcttgggatcaagtgaggcttctgcctctgcctcccaaagcactgggattacaggtgtgagccactgcacccagccatttatcctttgtgttgcaagcaatccaattacaccatttttagttattttaaaatgtacaatttattattgactatagccaccctgttgtgctgtcaatagtaggtcttattcattctttctaactattttttatacccattaaccatccccacctccctcccagttccccactacccttcccagcctctggtaaccatgcttctactctctatgtccatgagttctattgttttgatttttagatcccacaagtaactgagaacatatgatgtttgtctttctgtgcctcgcttatttcacttaacataatgatctccagtttcatacatgttgcaaatgataggatctcattctttttatggttgaatagtactccattgtgtataggtaccacattttctctatcctttcattcattgatggacacttatattgattccatatcttgtctattatgaatagtgctgcaatctcttcaacatactgatttcaattcctttagatatgtacccagtgcattccttgtatatgcacatgtacgtaatatgcatacgtatacaaggaatgcactgggtacatatctaaaggaattgagagcctattaaggccatattgggatttatagaaaaaatcatgattagccatatataagcttgccattatatcccacaagagagcatagcatgtaaacacatttcattaccagaaagaaaaatatcacatacatgggaaactgagtcttagagaggcaaaatgacttacccaaagttttacgagtctgaatcaagcccaagttgcccaagttgggcatttatatacctcactgtagtacttctcagacaccagtatcagcatcaactcctttggcattgatgaagactggctgaaagagttgagagtattttgtttagggaagagaagcctagctgtggagcaagattggcagaggttgctgtgttcaaatatgtgaagggcatgcctgaaaataaggagcagttatgtctgggtggtagtccgaggacagaacttgagtgagtaggaggaagtcataggggagcaggcttggttcatcagcaggaagaacattctgacaagtggaatcctgtgcctgcagagagaggcagggaacttccaggtccatcccagttcagttgtaagatatatggggagcacttggcaggaaggctggtgagggaaagctggcagaagggaaagagggtggcaacaggtgacctgaaagcttttctagcctgagcctggtgagggcctggagtgagaagggctgaccaaggaggacaggtggcctgcaggcctcttctgcacctgacactttggtgccttgggtcagctctgtctgtctcttggctgcccagctccagccctgcctcttccctgggtggccaagggaagcctatggggtgcaggatggaaaactggaacctcttcctcccaaagacacacgggctgttactccagcagcagtcaaggtcccaagtccacactgtggccccttcccctgcccaccatcctgaatctgagctttaatcttttgagcagaatgggctcaggctgtcatgggctttagctcttggtgttactgcctctgattagatccaggaagccctgttcacttcatggggctattatatgggttccttgcggtgttcaccattgttaggagcatgtggatgagggagggataggtaagagggtgaatttccttcaggttaagagtctgggtgcctggccccatcctgtggccagctcaggccattccgcccaggcattcgtagtttttcctggactgtgactatggccagtcagcaacatgcccccacaagtgtagaaaagaggcaccactcctccttgacacattatagctgagtggtccatgttggtgtccctaaatggtgagtgacagctgattccgagctagctcaagggtaggggagaggaggtctgagactcctgttacagccatccagaaccccaggaacagtctttaacatctgtttgaatactaacctataggacattggcctcacagtcacatgtgagtcacatgcagcaggatcatctgtgttccttgtgagaaatacattttcccaagccccatcataggtctaataaaccagaatctctagaaatctgcattctttacaagcttctctagttgtttctaaagaatactaacctatagaaaacacttctgtgatgattgaagccgaaatagactgtaagaaccatcttactttcgccctccatcccctattgttacagattggaaagcagagaacacagagagtaaatgacctgtctaaggtcatatagtcaattagtgtagtggtaaacccagaataatgaaccatggtgctgtttcctgacccaggactactctcctaactatcaagccaatcctttgttagatcaaagagtgaagaaagtgttttgaataagcattaaatgttacattgcatgaagatcatgtgtttagaacagactatgctcatcctagcctccatggctttactaaagtaccctcttcccctccttccctactttttctcttttccaccttcacaaatctacccatcttcaaggtccagcaactcagtccactttcaccttcctgtggtctctgagcctactcatatggcccttcagtatattttgtaatggagccaaagcgtttattttctgttcccaattaggtagcaaggactagatttcaacctctttttatctgctatagtccccttctcctgaggctaggccccaattaggggctcagaatatccatattaaaatccagttgttgagcaacagattcagtacaagccagccaaacagctagccatgtagctctagcgatatatttttgttgtaatcatattaaaattctacaagatgtatagcacagctctcacacctagtctgaggtctcctaggctttccaaactgcactaagtcctcgctcagcagcccttttgctgttaaacagtcagtggagtgtttgcatggccatccttatgctagtcactgtgggtattacaaaacaaaaagaaaatactgcaagttgtgctccagcttccacatggggagaatggctgcatcctgcactcactgttatctctggttccagtccaggcattgtatgttcttatactccagcctcctttggatcagtttcttgttctggcctgtccataaatctctccctcccttccttctctgcctcctttgtaccatctgtctcaaaccccagtcagcagctgctagcagtaaggggctctgagaacccaagtggggattttccagacacttcacattttcctcactgttaaaaaatgtgttttgcttgcttaaagtgactggattcctcttgccctcagtgaggctgggtgaatgagactcttgtcctaagaagatcaaagagagtctacagcctaaacaaaatttagctgtcattgtctctggaaatcctagcatgtatgaactgtaatctcctcaggtaccgcctacatactagcccaagatgttagagcaatgtgtggttattttcctccctactcccttccttcttgagaaccagagttgctggactgctgcttgactccttatcctcctccccactgctctctctctcgctcatggtgtccaactcatttgctctgtgccttggtcattcccctttctcagtggagacctaaggtgcgtagggcggagccttttcctaaggcttcacagatcctctctccttgccatgttgcttgatatagtctgttcctttttgttcccaggcactcttcccaccaagtcctaaccacctcctggccttttaaaggggcaaatgccagacaaccatagtctacatgagggacagtgtctacatatataacaccgtgctcacacatactctagaagttgtgggcctcttagcacgggcaatgccatccctactggctttctccagacttttgggagtttgcctctcatttgtgagtgtgaagctaagctacactgaaccaatgtttcaggacctgaacaaatgttttgggacagttactaagtttagctttagcatctacactgtgctgttcacatgacagggcatttccacaaccgttgtctcattgaatcctcacaacagcctggtgagataaatattcttatcctgatttttatttgtgagcatgctaaagcacaataatatcattaatgactaacattcgtgaagcgcttgctatgtaccagacagtgttctaagcactatgtatatattaactcatattttcctcacaacaaacccattatctggttattacaattagcttaatttttcagaataggaagctgaagcccagaaaggttaagagtttaagagtccggctcagggtcacacagctagtaagtggtagagccttattttgaacataggcagcctgattcctatgtaaatctaaatatgtaaacactatgttttttgttttttgggttttttgtttttgtttttgtttttttgttttgttttgttttgagatggagtcttgctctgtcgcccaggctggagtacaatggcgagatctcggctcaccgcaagctccgcttcctgggttcaagcgattctcctgcctcagcctcctgcgtagctgggactacaggcacgtgccaccacacccagctaattgcttgtatttttagtagagaaggggtttcaccatgttagccaggatggtctcgatttcctgacctcgtgatcctcctgcctcatcctcccaaagtgctggcattacaggcgtgatccactgcgcccggccttttttttttttttttttttttttgagacagggcctcactctgtcacccaggctggggtgcagtggcgtgatctcggctcactgcagggctcaagcaatcctcccacctcaacctcccgagtagctgggactataagcacatgccacaacacctggctaattttgtttattttttatagagatggggtctcactatgttgccccagctggtttcaaactcctgggctcaagcagttctcctgcctcagcctcccaaagtgctgggattacagccatgagccactgtgtccagccaacactatgctacttggacatggaaaggttgaaaggttaactcacacactcaaagccacaggaatcattcgatgatagattccaagctgtacagtaggctttctgatcccaagttctgtactcttttcactatacattcatgttttcactcatccaataaacatttattaagcactactatgtgccaaggtttgtactatgcactgggcataaaattgttgctcaaaaggagctcaaagtctaaagagagagatagacaagaaaacaaaaagcaaaccatggcatgatgactgagagcatggctttcatcttcaatgtatctgagttcaaatcagaacactactatattttgccagtaatatattaacctttatagtctcatccacagaatggaaatcataatatcagttcattcctaataggattgtcatagtgaagactggatgaattaatatatgcaataaacttaggaaggtacccagcatatagacactataataattattattattataggtttctctgttttatgatagagtgcgaatggctaagagaaggtcctaagccagtgtttgaagaagagacagaagttgcctggatggaggatgcagaagagggaggcaggggctagagcaggaagagctttgaaaagcatgtacaatgccaagctaagaagcagaatgggcttgggtcagttgaatagcacctacatttctgctactttcaaggaagagcaggctgatgaccaacctgtgtaagtggtctggtgaccctagcatgcaacaaacattttttccttaactcaggttcagattgaatcgctgtgagtggccatatgaactgctggtctgtctctgaaagaggctcaaccctcccttagctgtcagcagccttgtactccacctggcaacagctgggaagaatgagcctattggataatggcttttggagctgacttgtacgtggggatttggaagagaggtggatggagacaaagagggtgaggcattgcactgagccattggatagtgtgtggccaaaagagccaggcaccttcaggatctgctaggatgactttcaaacagcttgcgatgattcaatctgccccccagggatttttttttataaaagtatattttacaacttgggccagacaaaccagtgtcagttttatggccactatagtttttggttatttattccccatcttctctttgttttttccaggtgacctgctttaactgctagaccctggagagtctaaaaagaaaagtaataattattccttatattggtacaatgctttatgatttacaaagaaaccccacattcattggattttacagtacttctagaagggaggcaggacaagcaattacatggtcatcatttcctatgttacagatgagcaaatcaaggcaaagagaggggaaagcacatgtccagagttatacttccagggagcggtggagctaggactctgtattaattttctatgctgtatataataaattaccacaaatttagcagcttaaaccattacatatttattatttcagagtttctttgctcagaagtctgggcatggcttagctaagtcctctgcttagagccttacaaagtcacaaccaaggcattggccaggtttgggggctcatctggaggcttgattaaggaacaatctgtgtctccattgtgtggttgttggcagcattcagttccttgttgctgcaggattcctggcagctcacttcttgaaagccaccaagggggagagagtgagtctgctagcaagagtgtatcttataaaacagaatataatcatagaagtgatatcccattatctttgtcatattctattggtttgaaacaggacacaggttccatccatattcaagggaaaaggcttacacatgggcaggaacaccaggagatggagactgtgattgccaccttaaagtctgtttgccatagactccaacccagctttgtctgacgccagatcaagcggtctttccactggatcacactgttgccattaaggatgtgtgacatacattatcaccactctcaaatatacatacactcattcaaagatacatttgccaagcacagagtggagtacctctaagaagcctgctcttccccttaaacctgtgtcctgggttacacagcctagaatcctaactgactaacttatgaatacacccagactctcttaactcagaaaaaaattttatcacttctaaagatggaatgttgttttgggacaatttcgtgcaaaccctgagcttgttatcttcaaaaaagaacgcgtgtctttctcatttaggagacttaaactcttatcccgacaacttccaaattacttacaaaggcaaaggaagtcgtgctgtgttttgcttctttagcttttgtggctaagtctcattattttgatcctattaatgactgtcagagaagatatggccccggaggaaaggggttaaagagaattctttaaatctctcagccaaggccagaaagctctctgaggatagcttctgagtttaggcatgcctgcaaagaagcccggcagctctctccagatgcctgctcttcactgacaataggggctaccttaactattcatttcgtcattcattcagtcagtcagcaagtatttattgagcacttctttgtgcaaggcagcattctaggtactagccatactgagaccaccatcctcataagcaagaagctgacagtggagtgaagactcagacaagaaagcgattacaaggctatagaattgctttaatgcaggtatgctctgagcctatggtattctgtctgatggggttaggaaagatatgtgcttgctccagattgcaaacccaaagccttcaggaccaggccaatgaatcaaacaggtggatgcagggagtggtagagtttgcaccaaactggagggcactgtaataaaaaaaaaattaaacaccatgtggtcctaataaaacatgccctggaagctgccaatttatgacccaagcttagacaaaggaggtagtgtttatgctgagatttaaatgataatagcaaacacttacatagaggttactccgtaccaggtactcttgtaaacaattaaatgtattaactcatttaatctccataacaagcctattaggtaggtacattaattagccttgttttatagatgaggaaatagaggcctagagaagttcgacaacttgcctgacatcacacagctaatgaccgcagctggaattcaaactcagacagcctgggttcacagcccatgtggcagactaccatgtcctcagcctctgctaaaaaaatgactaagcgtttgaaaggcagccagatagcgagagaacatgtcacgcagaggaagcagcatctacaaaggcggaggcctaaagagtctgagggattccagggtccttaaaaattgtagtatttctggaatagcaagtgtgtgttttgaggtaatgggggaatgggtggagcaaggtcaggagatagatggagagaaatgaggtcagaggtcaggcagagaggctcatgcctgtaattccagcactttgggaggccgaggcaagaggattgcttgagcctaggagttcgcgaccagtaggagcaacatagtgagatcccgtttctacaaaaataaaaacaaatagaaaaaaaaatagctgggcgcagtggtgcacacctgtcccagctacttgagaggctgatctgggaggatcccttgagcctgggaggccgagactttagtgagccttgatcatgccactgcactccagtctgggtgacactgcgagaccctgtctcaaaaaaagaaaaaaaaaaaaaagaaacaagaaattgaggccagacagaaaaatcaacaaggacttgtatgccatgcaaagcacttacccattcattaaataaacatgtattaagcacttgctgtgtgctaaacctttacaaagcatcatgctaaggagatagatctaggcacatagtatttttttttggaggggtggtccagagaaggggcatcaaactcagcatgagggaatctggaaacatgtcccaaaaaagtgattgaattgacctaagccttaaaggataagtagaggttggctaggcaaaggagacacgaaagggcattgcaaagagagggaacagagtatggaaaggcatttctgaactcatggtaataatggttgtccttcttgtctcaagttttccccttctttctattctctcacctattcacatgtcacaatgggagatagaaagccagagaagaatcagacccagagttgctccataggatgcttatggtctggcatacctagcagaggaaagggggtaaagggataaatttgggattagaataactgaatttgggctcaagcactttatgcacattaactccatttaactctaaggctcgaaggactgatatgtgagggaatcatcacatcaaccttgcaaacttttccttttgatcctttatccctattttataaatgaggaaatcgaaggtcagagaggtgatgtcacctgcttgaagtaactctgttagtaagtggcatgatttggggtttgaacccaggaaagtctggctccaaaacctgtgttcccgtgttctcagcttccgaggaccttctctcccctgaaagcatgaagtcttttagtaacaatagctaaaaatcatttattgcaagctcagtctataatttcaaactgcttccctcaacatgtcagtcctttgagccttagatttatcagctgtaaaagaagactgtggtagaaaatactactgttcaccaatattcagttcctttctactttcagtaatataggggtgctatacctcttttcttccttgaagctagatatggccatatggcttgctctgatcaatgaaatatgagtagaagtgacatgtgtcactttagggtggaagcatttaagagatcatgtgattctctgtcttctcttaacgctactactagataacattccgaatgatagtacctccactggcctgggtttctgtgtaaaaatgacatgtaccagagtcctccactggctagcaatggacatgaatgaatatattacacacacatgcacacacacacacatacacaaaagctttcattggtttaagccactaaaattctggagttgtttgtcatctcagcataacctattatatcctaaccaatatagaggttaatggtctctatctcacagatttgtcgtaaggatcaatggaataatggaagtagaggtgctttatagattctgaggctgtgtgcacttgccaagtggtatgtctgagttcaggtcctattgaactgtgctctaatggaatatcactgtacaaataagatatttttagacacttgtatctttttatattatgggcagatatttacttgtctgcatagcattcttgtgtaggaggcttcccttttatagataggagggaaccaattctgaaaactgaaattcatttcccagagactatgggtagctgatacaaccagccatcctgatcaaaatggttactactggttccaatttttttccatctaggctcaaagaagcaatttagggagaccctgccctgatcctctcaagtagcaactctggattctactcctagaacagaggaaaagctgctgatcctaggcctgatagttccaagctaataaccctgacagaaactgacttgcaaaaaaaaaaaaaacattggcctgaaagggctagtaatgacatttgtcatgtggggtggtttagatggtctatgaccatgggaaaaagccaattcccccccaggcctaataatctcactccttaatctagcaaactcactcctgaaattcaattctaaagtaaaaatttaatagaaaaaaggctatatctatggatatttttatgatagtaaaaatacagaaaaacacttaaaactaaacaacagggtaaaggctatacaaaattaaaaggatagttacaaaaacgttgcagaaacatggaaatatatgtcagaggtgagaaaactgatgcagaggaaagccaaatcaataatgtgagttcacctgctcaacaaatggtaaagctgggacttgaaccgaagcaatgcagcatcagggtttgtgggtgccttattctgctcgggctgtcacaataatataccatagactgggtggcttaaacaacagaaattaattttctcacagttctggaagctgcaaagtccaagactgaaattcttcctggcttacagatggctgcctacttgttatgtcctcacatggtgggaggtgagggtgtgtgtgtgtggggagagagagagagagagagagagagagagaaagagagaaatagagatctttagtgtctcttcctcttttatagtaatgcaagttcttacatcagtgttccaccctgatgacctcatttaaccttaatcacctccttaaaggcaatatgtggggtgttagggcttcaacatataaattttggggagacacaattcagttcatagcattctatctctgggcctctgaaattcatgtccttatagcaggcaaaataccttcatatcatcccaacagccctaaaactcttaattaattttagtatcaactctaaattctgaagacccaagtttcatctaaatatcacctaaatcagagatgggtgagaaatgaggtatgattgatcctgaggcaaaattcctctccagctgtgaacctgtgaaaccagacaagtcatgtgcttccaaaatacaatgatgagacaggcataagataaaaataagtaggaaagaaggaaggggtgcagggtcccaatcaaatccaaagcctagcaggacaagttttattagatcttaagattcaaaaataatcctctttggcttgatatccaccttccagacccaatggggcagtggcttcacccccatgtccctgtttagaagctgtttagtttcagttgaaactgaggcaatggcaccaccctttgaaaccaaggaggcagacatgatgatctctgaatcacctttggggtgagtcattcttcccttttcttgaagaatagtgcatgttggcaggtgaatgactctatggtctggtcttgtaggacctaagaaatccaacagccttcctcatttagtctcattttttttctgtcttctttagttcctgttggtatgtttctcccagtataatcccatctctattcctggcttctgctgagatagttggttaaatccatgtgttgcacccataatctcttcatcaaatgattattcagccacacccttagtgttctcttcagaaacagctttctcattttttataatatggaaaaattgaaaattttccaattctccaagttatttagaattggataatgggtagagtgttaggcaaaaggtgactttttgcctaacaattccttcttcaattcatctctcttctctcacattttgctataagcagtaaggaggatccaggcttcaccttcaacactttgcttagaaatcttctctgctaaatatccattttcatcattcacaagttctactttacacaaaacactagaacacaatgaagccacattccttgccattttataacaaagattgcttttcttccagcctccaataacctattcctaatttccacccaggacctcaccagaattgcctttaacatccatttttctagcatgcacctcaaaactcttccagccgctacccattatccagttccaaagctacttccacatttttagatatttgttacagcagcaccctacttcttggtaccaaaatttgtattagagttctctagagaaacagaaccaacaggaatgcatatatatatacatatatatatgtatatatatatatgtatatatatatatgtatatatatatgtatatatatatgtatatatatatgtatatatatatacatatatatgtatatatatgtatatatatgtatatatatgtatatatatgtgtatatatatatatacacgtatatatatatgtatatatacacgcatatatatatatgcatatatatatatgcatatatacatttggctcctgtgattatggaggctgagacatcccaagctctgcagttggcaagctacagacccaggagagccaatggtatagttctagtccaagtccaaagacctaagaaccaggagagccaatggtgtaagttccaatctgagaattggcaggttcaagatccaggaagtgcagatgtttcagtgtttgggtcataaggcagaatgaggagatgtccctgttcaagaaggaaggcaggaggagttccgtcttacttgtaggaaggtcagcttttctgttctattcagtcctttaatttatgggatgaagtccaccaacattagggagagcaatctgctctactcagtctattaacttaaatgttgatctaaccaagaaacatcctcatagacacaatcagaatgtttgaccaaatgtatgggcactgtgtggcccattcaagttgacgcataaaagtaaccatcatagtgggtttaaccacagggttattttcctagtgtttgcatttcttggcccttattaattggccttttgtacaattttcttaattattttgcctgtttactttcctagtatatgttattttttcaggcttcaagaaattattattagattttcactggaattgcctttctccaattcaacctcctcaccactgccagggaaaacttcttcgagtacaaatcacatctgttgctctcttgattaaaatattttaatggtttcctaggctcctaaactcctcagtaaagatactaggcctttcatgatcttacctctaccaacctctctggcttcctgccacacttctcctgctacactctagttatctctcataatttgcatttccctaagtggagtgtgtgctctctttttctcccatgctcttgctcatgcttagaataccttcttgacccacccatgccaagtgaacatctacacttattgggcccccctgggcccagcacgaaaagaagtttcaaagaagaagaaatcagcaaagttaggagatcaagaaggaggcagacagagatttagatcatgtggaggtcactggaacctctgagataaagtataggttgaatggcaggagccaaagtcactgaacaagtaattatgaagccagatgtttgatggtgaaacgaaagaaagagacaaaaatagatctccagagagtagaaacattgagaggaaagcatgtttaagatggttacttgtagagtttcttacataagccattgagcaatttaaatatcactcaattgatggcagggcaaaaatcattttcgaatgctcctagctgtactcatagctacaaaaccattaataatcctgtaaacatgtccatgtcatgcaatagaaactcatattttcaatctctatgttaggtggctcaaagcaaggccctccaattggaccactcaaacaaattccactcttggcaaatagatagttatgatttctggtctcaaattctgcaagttaaatgccaaaccataccccttcttatgcaaagcatctttttagagcacctctccagtgctgttttctaaatctcattctcctgctaatgacaccctgtctttctttctatctctctcccaattttcaccctcctcttcctttccccatggagtatccagagattcatagtttgtgaataattattagtctgtataaaagcttggtttgatggtgggagttggggcaggagggttctgggtctgtttagaaagctactagagttgagaaaacagagtggtatatacaagacaacatacgtgcaaatttgagccaggcagggtaaaaaatccagactttttgctgtcacagaccctgttacatcactcacttatgtattaccctccaaactcagcttatttatatagaaggtacccagacaataattcccaactagagttgtactttatcaattcaaagaccctcccctctacaaatcccatctaagtacttacccaagccctttctgctcaacttagacctcaggacttcaaaatccttgtccctcagaacaggatttacctaccaccccatcattttccataaataggggaaaaattaactagcattgattgactacctcctgggtagcaagaatttaaccctcatatgggtgaacttggcactataacttcatcttacaggtggggaaactaagacccagtgagggacattttcaaagtcatataggtaataagttggcataagtggaatgggaataaagcaagttcaaggtccatactttttccaccacccttcaacaacatctgtgggaacagattttttaaaacaggaccgtaaagcttatttgtatcgtatgccttctcaagttctgtttcctatccaatcctcaaatttccttttcctcaaataactaataaaattggccagtgcaaggaaggtatgtttagtagtttacaaggagtagagtttcagagagaaagtataatggagttttattttcttacttcctgtctcctgttacagttcttgcagaagagtgggaatcttttgatctggggtactgaaatcccagaaatatcaaccctagtcagctccaaaaagcccataggactgggtgggtttaatctccttctcggtaggcctgaaagtgaccagaggaggaagcctcttggcttgttcaccaggtttgtgatacttatgagccaggtgtccttttggccctccacaaggactatgaaaagcttgtgactttctggatctgtttatctcatggacttggctctgctgggggatcctaatatacccacgccactgtgtctcaaacccagagggatctgctggaagggatctatctttggaaatggcctgaaccctcctgctgcattctacttagttctctatcttgggcatctgggatggagagtaaaggtgattttaattgctttttagctcaacaacaggatgattaaaattgcttaaagtatgttttaagctgcaaatcaacctttaccctgtagttacttatattttaaattggcttgtttctgttcccgtgccatcacaacaacatcagttctgagcaaaatggtactgttaactgtttcctatcacctacctctcacttccagtttctccatctgggcccctcttccttttttagcacttctgcctccctcagggacttccagtaataccaatcccttgctcaggaaaatgaaactctcatgggatatgatccagagacagtctaataggagtgatggtttaatgcagtgaggacctcaatgatttccagaagtcccaccacttaagtatccttcagcttccccaaataaacaccctactcattactatgtacagcttctctcaaaaagtgccaaggaaactgaggtaaagtcattcattccttcatttgcttattcatttatttaccaatttttgttgaccacctcagctgaaggcgttctaggcaaggcaagcagcatgagaaatggcagggaggattaagggagagactggctggttgaaagaatggttagtactttggtttgaatggaggataggatgcaaatgtggatatgaacatagatgaagtctgataaatatttatggatcaaatcagatcagaaaggccttgtttgtctttctgaaaagtttgcgatgtcatcctgaaagtagtggagaacaactgaaatgtgttaagcaggacagtgacataatgagacgtgctttagaaagcttactcttatagtcgcagtatagatgatcttgaacatagctaaggacaacattaagatatcatccaaatgaaaaacagggccttagcctattaaacttacagataaacacctctttctttaggggacatcagaaaaactaagtatagcttatttaaaagcaattgagagcagtctatttgagtctgatcagggcaccccaaggaaatctgcttttgttggctatgggcccaagctttctgtctatggcctaaccttaaccaatttctggtttttggatcttgaaaaatagaactggtacatgacatcaacacttacaactttctcccactaaaaatttttctggaccccacatttcccttcagctaccatttttctctccttataacaacacttctataaggattttctagcctttttccattgcctctccttctattcacttccaaacacaaaacgatcacattagtgctacttcactccaccaaacagaactattacctgttttctatgactttgatgctaaatctaatggtcacttgtttgctctcattttctttactactgtgcataattcaatacagttcatcattttcttcttcctgaaacactgtctttggcttctgggctcagcactctcctagctcttgtcctgcctgtttgtccctcttaggtttatccaattttcaaatgttggcatcatccagagtttcaccctaggctctctcattttctcaccctgtactttatctacatgaactcaaccattctcatgtcttcaataacagtgtatatgccaatgaataccagttttatacttctagatttctcttctgagcttcagaatggtataggcttacctcagagatattgcagatttggttccagaccaccgcaataaagtgaatatcgcaataaagcaagttacatgaattctttggatttcagtgcaaataaaagttatctttatactataacacagtctattaggtatgtaatagcattatgtctaaaaaatgtacataccttaattaaaaatacttcactgctaaaaatgctaatgatcatctgagcctttagtgagtcctaatctttttgctggtggagggtcttgccttgaagtgtatggctgctgattgatcagggtggtggttgctgaaggttggggtggctgtggcaatttcttaagataagacagcaatgcagtttgctacatttactcactctttatttcatgaaatatttctttgtagcatgccatgctgtttgatagcattttactcagagtacagcttcttttcaaaattagggtcagtcctctcaaaccctgccactgctctatcaactaagtttatgtaatattctaaatcctttgttgctattttagcaatgttcacagcatcttcaccaggagtagattccacttctcaataaactacttcatttgctcatccataagaagcaactcctcatccattcaagtttggtcatgaaactgcagtaattcagtcacatcttcaggctccatttctaattcttgttctcttgctattttcaccacttctacagttactttctccacctctcaaagtcatcgatgagggctggaatcaacttcttccaaactcctgttaatgtggatatttttaccttcccctattaatcatgaatgttcttttttttttcttttgagatggagtcttgctctgtcgcccaggctggagtgcagaggcatgatttcggctcactgcaacctctgcctcccgggttcaagcaattcccctacctcagcctcccgagtaactgagactacagtgcatgccaccacgcatggctatttttttttttgtagctttagtagagatggggtttcaccatattggccagcctggtctcaaactcctgacctcaggtgatctgcctgcctcggcctcccaaagtgctgggaatacaggtgtgagccaccgcacctggccatgaattttcttaatgacatttagaacagtgaatcctttccagaaggttttcaatttactttgcccagatccaccagatgaatcactatctatggcagctatagccttatgaaatgtatttcttaaataataccttgaaagtcaaaattactccctgatctatgggctgcagaatcatgttgtgttagcaggcatgaaaataacatgaatccccttgtacatctccatagagcccttgcatgaccaggtgcattgtcaatgagcactagtattttgaaaggaatcttcttttttctgagcagtagttctcaacagtgggcttaaaaatattcagcaaaccatgctgtaaacagatgtgctgtaatccaggctttggtgttccatttacagagcacaggtggggtagatatagcataatttttaagggctctaggattttcagaaaggtaaatgagcactaccttcaacttaaagtcaccagctgcattaacccctaacaagagagtcagcctgtcctttgaagctttgaagccaggcattgacttctttttatctatgaaagtcctagatggcatcttcttccaatataaggcttttcggtatatattggaagtctgatatttagtgtagccatcttcatcagtgatcttagctagatcttctggataactttctgtaggttattcattattccttgctgctctaccttgtgcttttatgttatggagatggcttctttccttaaacctcgtgagtcagcctctgctgacttcaaacttttcttttgcaagcttcctcacctctctcagccttcatagaattgaagagtccggggccttgttctggattaggctttggcttaaaggtatgttgtaggtgatttgttcttcttctctatttgatcttctatccagactacaaaaactttcttcttatcagcacaaaggctgtttttctttcttataattcatgtgtttgctgaagtagcactttcaatgtccttcaagaacttttcctgggaggtgtacttcaagatggctgactagaggcacctgacactcacttcacctgcaaagaaggaccaaaacagtacgtagataagaacacattaagtagagattctgaaagagaacactggaattcagtggacaagtgacagggaacctctaaggcatagaaggagagggaagtaaagcatcttgcctggctagaattagctcacagctaggaggaactgagcattacagaaaaaaagtaagtgagagatccccagcagtccgcatttcctccagactcctgtaatcctagccacaggagagccccttggcccttgcaggccccgaaactagtataggaagctgcctggaatccatgtagcagcactgtctcagagaggttgtttaagctgggtcctacacacctccagaggtgcagctgcagcatggcaccattttgacagcccagcccccataaactacgtagtctactcccatggcaccattttgacagcccagcccccatagactacattctgccttgggacccaacagcccctatatctctacatcactggagccttcctgacatccccctacacccacccagagggttgcagcctcccgatgttggctagacccagtggtgcagcaggggtaccagcattgtagcccacacagtgttctaaaacccagggaatgggtagtgcagtgtaccagggaggctgcccctcaaacaaagggagctgaaatacgtggtaaccatagcctgagagctgcttacatggggctactgccactgccagcaacactgccccctacagtggcagggccaccatgcacctgcatgtgccttcaaggcgcctagggaccagtttgcctatgcattatttggggggcctgagcacagacctcccttcccaccatcaccactgcaggtacacgaatgcagtgtctgagatgtggggattgacttgccctgcccaccacagctggtgcttgtgagcaccactgagaggccttagtacaggttcaacgcaccggccaccaccactgttggcaccaccacatgttgtccagcggcctgaggatagaacaaccccatttgcaaccaccagtgcccatgcatgccattcagggacctgaagacaagtctgccctgcccacccacattgctgctgccaccagcacccatgcatgtagtcccagtgcctggggataggctcaccttgcctactactatggacacacatgcacaccatctagaggcataagggtgagaccaccacaccccaccccaccccaccaccagtgcccatgcatgcctcctgggggcctgggaactggcttgtccagtctgccaccactgccaccagcacccatatgtgtatgccgcctgggggcgtggtgacttccctgctcagcccgccaccactgctgacatttacaggagccactcagaggcttgagagttggcctgtcactgccactaccaccactgatatcacagacaccacctgagggcctgaggatctgcccacctggcccactgctgccaatcctggcacctgagcacaccacctggaggtctaaagactggcatgcctgcctgctgctaacagcactagtacctaaggactggcctgcctggcatgcccagccacagaaaagcctcatcatagcctccattaataactgcagccaacccactgagtaactcatggacaccactgacactgattagagccaaagaaatcatacagaaaatacaaactgtgcccacccagaatcatagccaaagaaccctatccaatcaacactacaaacacatctatgtgaaaaaggattttcctatgaaagataattcataaaattagaggaagtgactgttacaccgggtatcaatgtaagtacacaagaaacatgaaaaaagaaggaaatatgacacctccaaagcaacacaattatactccagtaacagatcttaaagaaaaagaaattaaaaaaagaaaaataaatttataaaatgcctgaaaaggaattaaaaataataatattaaagaaactcagtgaagtacaagagaacacagataaacttataaagaactaacattgatactcaaactagtccaaaacatgatgaggacagaattcttcctaaatcattctacaaggccagcatcactctgatatcaaaactagacaaggaagcaacaacaaaagaaaaccacaggccaatatccctgatgaatatagatgtaaaaatcctcaacaaaatactagcaaatgaaatctagtaacacattaaaaagataatatactatgatcaagtgggatttatcccagtgatgcaaggatggctcaacatatgcaaatcaagaaatgtgatcatcaacaaaatgaaagacaaaaccgtataatcatctgaatagattcagaaaaagcatctgatataattcaacatctcttcatgataaaaactctcaacaaattaggcatagaaggaacatacctcaacataataaaggctgtataggacaaatccatagcaaatattatactgaatgaggaaaagctgaaagcctttcctctaaaactgaatcaagacaaggatgctcactttcatcattcttattcaacatagtactggaagtcctagctagagcaatcaggcaagggaaagaaaaggcatccaagttggaaaagagaaactcaaattgtttttctttgcagatgaaatgattttatatttggaaaaacctgaagactccaccaaaaaaactctaggaactgataaacaaattcagtaaagttgcaggatataaaattaacatacaaagttcagtagcatttccacacaccaacaatgaactagctcaaaaagaaattaagaaaacaatcccatttacaacagctaaagacaaatatctaggaataaatttaaccaaggaagtgaaggacctcagcaacaaaaactataaaacactgatgaaagcaacttgaggacacaaacaaatggaaagatatcctatactcatggattgcaagagttaatattgttaaaatgaccatactacccaatgtgatttacagattcaatgcaatccctatcaaaataccaatgacattctgcaaagaaatagaaagggaaatactaaaattaatatggaagcacaaaagaccacaatagccaaagcaatactgagcaaaaagaataaagctgaaggcatcactctacctgactttaaaaaatattacaaagctatagtaatcaaaacagcatggtatcagcataaaacagacacatagaccaatggaacagaatagagaacccagatataaatctatgcatttacaatcaactgactttcaacaaaggcaccaagaacatacattgggaaaaggataccctcttcaaaaaatatcactgggaaaactgcatattcatatacagaagaataaagcatgacccctatttaacactatatgcaaaaatcaactccgaatagattaaagacttaaacctaagaccaaaaactataaaatgactagaagaaaatacaaggaaacaattctgcacagggtctaggccaagattttatgggtaagactttaaaagtataggtaacaaaaacagataaatgggactatagcaaactaaaaagcttctgcacagcaaaataaataattgagaaataaaaataaaatcccaagtcccccagctaactgaaaagaccctctctcagccaagagcaccccagataaaccttaaaaactgtgttcctggccatgatggatgaggggttggatatacctgattatgctccttctttattaaccttcaactagaattctttcctaaggactgagcagaaactagctctggaaagtgagaaaaggataactcattcctttatcatctttagccaatcatctgaggccatgaccagactccctgtctttgcagtttcaatatgacagctcagcagcttcataatgcatctcttcctaataaaagaccactgaccagagagtggttctggccagtttacagaggatgtgcaatgagggttttcatgtcctctgttttaccatttgatgttagaggtccaaaaactccacccttggatcatgctaacactgccattttttgtacacgtgactgatgaagaagcatgaagctcaattgcacatgtgcacgcatctcctttcataattattcatgactcttcctataacttattgaatatgtatacttagccaacccattcaccataaattcttgtcttatgcttccctccctcaaagtgcttgctctcggctactgggcagaggctacatatcccagcctgtgggatggccagcctgcaggcttcattcctttatgagaaataaagccctcctttccaaatttaggaacctcatgattcttcaattgacatgaccaacaaagagacaacctatagatgggagaaaatatttgcaaactattcattcaacaagggactaataaacagaatatacaaggaacttgcacaactcaaaagcaaaaaaaaaaaaaaaaacaaataatcccattaaaaagtgagcaaaagacctcaaactataaaactactataagaaaacactggggaaaatctccaggacattagtctgggcaaagacttcttaagcaatacctcacaagcacaggcaagcaaagtaaacatggacagacgggatcacaccaagttaaaaagcttcttcacagcaatggatacaatcaacaaagggaagagacaactcataaaatgggagaaatatttgcaaactagccctctgacaaaggattaaaaaccagaatatataaggagctcaacaactctataggaaaaaaaatctaataattcaatcaaaagatgggcaaaagatttgaatagacatttatcaaaaaagtcatataaatggcaaacaggcatatgaaaaggtgctcaacaccactgatcatcagagaaatgcaaatcaaaactacaatgagatatagtcttatgccagttaaactggcttggatccaaaagtcaaggaataacaaatgctgtcggccaggcatggtggctcacgcctgtaatcccagcactttgggaggccaaggcaggtggatcgcctgaggtcaaaagttcgagtccagcctggtgaaaccctgtctctactaaaaatacaaaaattagccaggaatggtggggggtgcctgtgatcccagctactcaggaggttgaggcaggaaaattgcttgaacccgggaagtggaggtttcagtgagctaagatcgcaccactgcattccagcctgggcaacagagtgagactccatctcaaaaaacaaacaaacaaacaaaaacaaatgccagcgaggatgtggagaaaagggaaccctcatatgctgttggtgggaatgtaaattagtataaccactatggagaacagtcgggaaaaaaccaaaatagggttaccatataatccagtaatcccactgctgggtatatgcccaaaagaaaggaaaccagtataccgaagagacatctatactcccttgtatgttacagcactgttcacaatagctaagatttggaagcaacctaagtgtccatcaggagataaatggataaagaaaatgtgctacttatacacaatggagtgctattcagccataaaaagaatgagatcctgtcatttgcaacaacatggatggaattggagatcattatgttaagtgaaataagccaggcacaggaagacaaacatcacatgttctcacttatgtgtgggatctaaaaatcaaaacagttgaattcatggacgtagagagtagagggatggttactagagtctgagaagtgtagtgggggctggcagggaggcagggatggttaatgggtacaaataaatagaaagaatttataatacttactatttgatacataacagggtgattgtagtcaatagtaacttaactgaacattttaaaataactttaaaatgtaattggagtgtttataactcaaaggataaatgcttgaggggatggataccccattctccataacgtgcttatttcacattgcatgcctgcatcaaaacacctcatataacccataaatatcataaatatatacatctaccatgtacccacaattttgttaattaaaaaaagtgagcaaagaatgtgaatagacgtttctcaaatgataacataaaaatggccaacaggtatttgaaaaaaatgctcaatatcactaatcatcacagaaatacaaatcaaaaccacaataagatatcatctcaccccagttagaataactattatcaaaaagacaaaaaatagtaaattctggtgaggatgtggagaaaagggatcaattacacattgttggtgggaatgtaaattagtacagccattatggaaaacagtatggaggtttctcaaaaaacgaaaagtaaagccaccatataatccagcaatccctctactgggtatttatccaaaggaaaggaaatcagtataccaaagggatacctgcttctccatgtttacggtagcactattctcaataacaaagatatgcaatcaatctaagtgtctatcaatggatgaatggttaaagaaaatgaggtatatatacacagtggcatactattcagccataaaaaatgaaatcttgtcatttgtggcaacatggatttaactggagatcactggggtaagtgaaataaaccaggcacagaaataaaaatattgcatgttctatctcatatgtgggagctacaaaagttgacctcatggacacagagagtagaatggtggttgtcagaggcttagaaaaggaggggatgaagagcaattggttaatgggtacaaacatacagttagataacaggaataaattctaatgtttgatagcacagtggggtaactacagttaacaataatttattttatatttcaaaatagctagaagagagagtttaaaatgttcccaacatgaagaaatgataaatgtttgaggtgatggatatccttagtacactggtttgatcattacatattgtatacatgcatcaaaaaatagcatgtaccccataaatatgaacaattatgtatcaaaaaaagaactttttctttacattcacaacttggctaaccggcacaagaggcctaatgtggcattctatttctgctttagacatgcctttctcactaagcttaatcaagcttttgatttaaagtgagagatgtgtaactctttctttaatttgaacacttagaggccagtgtatggttattgattggcttaattttcatattgttgtgtctcggggaataaggaggccggagtcaagagagagagacagggaaatggcctgttggtggagcacgcagaactgacaacattgattaagtcagccacctcatgtgggtgtggttcatggcatctcaaaacaattgcaatagtaacatcaaatatcactgatcacagatcctcattacaaatataataataatgaaaaagttcgaaatattgtgagagttgccaaaatctgttacaagacatgaagtgagcatatgctgttgaaaaaaaaaattgcatgataaacttgcacaacacagggttgccagaaaccttcaatttgtaaaaacaaaaacaaaaacaaaacaaaacagaaaaaaacagtatctgtgaagtgtaataaagagcaataaagagaagcacaataaaataaggcatgcttgtgtatccagttacctatttagcatgtacttgaaatcataataaccaaaatcaaactcactgatgaaacgggagagttccttgacccccctcacaggacatgcaacagggatgtgactcatctgttcagtcactgccgctgctcaaaccccttatgggagggggagcagacagacaggtgtaggagcccaaatgggcgtgtgcccttttagccttgctgtccatggacggcttgagtgttaaccagctcagtggaccctctgcctttctgcaagggcagagggtcggtgtgacagctttctgtatcccaagctcttgtcccgcttcctggaagaatcgggtcacacgtggacttgaaggatgaatgcaggggttttattgagtggtggaggtggctctcagtgagatgaatggggagccagaaggggggatgcagtgggaagatgatcttccactggagtttggctgtccagtggccagactcctctctgatgaccacccttagctgaactcctcttgacgttcagaccttcctcctcttctttctctgctgcattgttctgccattcatctgcttgtctccttgtcttcttgtctgctcatctgcttctggagcctggggatcagggtttatatggatacaggataggggggcatgatgggccaaaatgcaactttttgggcacaaaaacagaaatgcctattctcacttagggccatgggtctccgggcttgagggtggggcctttgtcagggaaccgccctcttctatccagtgtttccatctcctgtgtgtgtcattatctccttttgtctccaaacatgtacttcttccagtgctcaccaactcaataacatggaaccccattcctccagtgcagcataccagaatttgatcattcttgataacttgctctcccaaatccaaaattgtttgtattgtctaaatggtcgctgcatgctttgacccctgattaattctccagccttatctcgtgttgtgtgctcatgccaaacttgccttctttcaattcctttgggacacccagaacacccaaaagtttggcctcagagtctttatattggtgtatcctcttcctggaatattcttcctccaaatctttacctgctgagttcctacttaacctttatataccagcttaaatatttcttctttgagtgaatcttcctggacccatctgactaaattcggtcttccatcccaccttcatatcctgctggtttattttcccaggggagcccataatttcccttcatagcactcgacaactgagatgagtgactgaggtataagtctcaatcactgcggtttattttagggtgtgtctgcgaagaaaacgaatcacagatacatccatggctgtttttctgaagaggttttcaggagattttgtatttgtatacttccttaaagcggggaaggcatataggaagagaggcaggtaggtgtttgggtgaatagttgcattcctgtgagatactagttagtgctcagtaaatctacattttatataagataaagtgaatgtctggaaagaaaaagggagtaaaagataaatcaattatgcagaagtctctaggtaggtggaggaaggagtcttgactttgttctgcacctgggaggataagcttgtaatgacattatcagtgtagaatcaaacagactttagtattaggagctagacttagattgtagacctaaagtcacatgtggcatatccttgtttatggaaggccagcaaataacttagttgggggtgcgggcagtccttcacagatatctgagaccttttacctttccgtggagatctagctgatgcataatatgttaggaacagctattcatttggaagagtgaccttcccttttgcattagaagtttgggggctcctgaggatttaaaattttcttttacacacactatcataattttaagtatttatttgtgagattgtttacataatgtctgtcttcactacttgactgtaaattccacaagtattgctcttgtttatgccctcaacactgagaactgacacataggaggcagttaataaatatttgttcagtgaatatatgtataaatgagtgaatgagtacaagtttttctcaaaaagcatatattcctctcttaaagaggaagggccttctcagtttgggaacctacttcagggtctgatgaatagatactctgattaagagctatctttgatggctgggcgcggcggctcacgcctgtaatcccagcactttgggtaggcagaggcgggtggatcacctgaggtcaggagttccagaccaggctggccaaaaaggtgaaaccccgtctctactaaaaatacaaaaattagccaggtgtggtggcacacgcctgtagtcccagctactcaggaggctgaggcaggagaatcgcttgaacctgggagatggaggttgcagtgagctgagatcatgccactgcactccagcctgggcaaaagagcaagacggtctcaaaaaaaaaagggctatctttcagaactcagtaaagttcttaacaatgttccaagttattttaccttccaagtttgagctaagtattataccgcgttgttctcttttgcccacagtcctctccctaggtttttcaccagcttttctttaacctgagaagagtcaaaaggaaaaacacaataaaaatattcactatattttcctgagaatctaaaacatttgaagtttgcttagagatttggctgaagctttggattgtttccaagtttggcaatcaatttatctggggctaattcagttttcacaaggtttttttttttccctcaactttcagtttcaacatgagagctggagttaccctcctcgtggttcaaatggagcagttaaactcagggcccaaggtagaaaatctgacataaggaatctatgcttccaaaccttgtgacacctggtggttatgttccagattctggctcctgggtccgtgggatctgtaagctctggtctttccaaaagtcttgtcatagtagtaggggaaaggaacacttcttatggacagtgaaagggaaacactaacctgtctactttcttccagacatcagaagtgaaaagtaagatagaggcatttctgaccttgtctgactcagtaggacagtgtcaggatttgtttagagagagaaagtgaccatccttaaaaaaaaaaaaaaaaacccttatgctccctactgtcagtctcaagtgcatggcttagttccaagccctaggtctttttcatttcaacaccaaactctacactggcttttgagatgaagacaggggttatagatctgcagaacagcagagtagctgctgagtgcttgaagagcccattctaaacctcccttttctctgcccaagtatccacaacaccttccctgtactgagttgttctggaccaggctccattgttattcagccatgcccaatccctgggaagctgacatacagtagaaaatggagtgataattatgcagccagtctctgtaggacttttaggggaaggacagtcttcctaggaagttagttgcctagtcatttgctttagcataaaatttttatatatattttatatatataaatggctacggagaccagacggtgggaggacagaggatgggaatatggtcaatgttttactgatgacttggttatccagcgatgatcaaaaactccagtggctccaccagctaatgctgtccatgagaaggctgaaaggatcttcagagattatcatgcttagctcttgcttgtttacttgactaaaaaaataaatactcccctggtttccctgggagttattatggtttgtaagcaatgataacagttaaaattctgcactctcatgctaaggtttacaaggttgtttctagatttctcttcctggagattctctacttggacaccccctccagcctaaagatcccagaaacatcatgaggagctctcatagggactgttggatagaagcaactctgttgccacgctgaagaccaaattctggagatctagcacgggaatccaaatctgaggagtgctgtagaagataagtacagactcaaaggtgtgacaaaagccgaggacttggagtcaagagacctgtgtgcaaatctgcctttcattataactgtttgatccaggttaaatcacttaactgctttgaacttcagttcctctttctctaaaacaggaatacaattacagtacctacttcacagttgtaattaatgaacaaacaaatgcacaaaggatccagtatacagtagataatcagtatcagtgacttgtatcagaacttctttcttacaactgctgtgccttacaaatgctgcccaactccccataagggacccatggtagagatgacactgctcttcaggtccttcttacaattttcaaggcaatatttgaaaaattctgaactgatcctggaatggcaaccttcttttctccacctatcaaaaccctatttgtaactgtggacccaattcaagtgtcaacctcattgcacatattcctcaaatactttttagatcttacctagggactaagggaagagttcctcaaggaagagatgcttgagctgacagatgaaagctgagtgagagtaccctagggaaggggagaggagattatattctgggtagaggagacaatatatgtaaagatcttcaggcaaaaggtaatctagtttgttggaaaaactgaaagaaaatcagaagaacagtgaggctaaagcacagggaaggccaaaagccttataaatagagtagctgtgcatggctgtgcagttggagcccaatacaaacgtaccctgtcaaaggggcgtgtgaggacggaaatccagcctgtgttctccttgctaaaccatgcatttatagggctctatatacccagaaggagtgcctttttctactttgtccacccttgttttaattttcagaaagataaacaaaagttagcagcatctcttacgaggccatgcatgttctggctcctatctatcacaccattcttacctggaactcttacccccattctcttctttgtgctccatccacacaggtcttctgcatcctcaggactttgcatttgttttgcttgttatatggggtttcactatcatctacctagtacaattcttggcatactattgaggcttgatgagtatgtcttagcattgagtccatgacctgaggctgatttggctccatccgagtctggacctgaaccaactgcaattgggttagacctgctctggtcttcaggctagtgaggctggtacaatgcccatttctaagtgctgggagcagtgaatcttcttacctaggcatggcaaaggagtcactttttgtcttggggctgctaaaatctttacagattgagagtcacaagggcttcttaatacaggcaatattaatttttttttctacatgggattgaaagaattgaggaatgtggttgtttcagactttcctgcacttcaaaactcagaagagctttctctaaggatacattacaacatattcaacgagagtctgcccatcagcctagatttctgaaagaatgataagctcctactgcaaccatttgttcaacaaatatttattgagcatctacaataattaataaaataggcatgatctttgacttcacagaacttagattttcgtgccatgttcagaagtctctgtgggattattttacaggggaaatgtgttttcttaaggtgccaaatgctcattggcagcttatatagcaactaataaagcacaagaagggtcagccttcctggggtccaaatcctagtggattctaccatttgagagctgtgctactaccctgggcaagttacctttttttattttcaattttctcacctgtaaatgagaataataatgctttaacctcatagagttgatataaagattaaacaaagcataatatgtaaaagaatgtagcctagtgccaaatcaataaatacttttatataacacaacatactcttgttttatggaaaatgaaaattatttttaagataaaatttatctgggaaataggtccatttctcacgaactcagaatagtaatcagaggaaatgtcatggctatgggaaatgtttcctatctattatgtcctgatccaggttgttattttcttgagatagaaatctttatcttggtgtctgccaaccaaccccagtgcctagcatagtgcctgggagcactgcagatagaggacttgtcctgttaatttctgtactcttagggactggtatagtgtctagaacaaagtatgcatattattcggttggtgcaaaagtaagtgcagtttttgccattagtttcaatggcaaaacttaatagctatataagcttatttttgcgccaacttaatagctgtataagcttatttcattctcacaacaaccctctaaaatgatgctattattatccttattattagatgaggaagctaaggcacagagagattaagccaattgccctaaattaccaagctaagagtgatagagctggaatttaaaccaagcagcctagctcttagcctgcacggtaacacctaacacaatcagataggaagtgattactagatatttgttgaataaatgcaattgcaagaaaatgtaaattatgttcatttaacggaagaattccattatacatgtgtgcttaatacaatagcgatattctgaaaagttagataaaaatcaattctttgtaaacttcatgcatttcactagtgtgcccagcacattgtagtttgaaaaagtaacccatactgagctttaagggttcctgctattcagagtaaactgcggtgatccgttttgttgtgtccttttgtcaagtcagtaatcacctcctaaactgtctgatttataattagtttttttcacatactggctttttctaaagcaggaagggctggtatatatccttttttagatcttgttccgatcacctattaaacggcccctccctaccccctatcaactagaaggctagagagacagctggtgccctcttctgggggtttagggctgttgcatacattgggcccaccacggggcatttccagaaaacaattatgtcaactacttttcaagtctgatgataagaatagggttggatttttattctttctttgaaataagaaactatatctttccgaaaataagaaagttgactgtagtgtccagaacaaagtatgcatattacatgcataagcttatttcattctcacaacaaccctctacaatggtgctattaatatccattttagaaaatgaaaataggagactcagccaggcgagtctcctgaagccctgttgggtagagggatggaattccactgtggtgctgagaagacgcttccttcagtcagatatattttatgtatgtatgtatgtatgtatgtatttatttatttattttgagacagagtctcactctgtcgcccaggctggagggaggtggctggaactcagctcactgcaacctccgcctcccaggttcaagcaattctcctgcctcagcttcccgagtagctgggattacaggcatgtaccatcatgcccggctaattttttgtatttttagtagagacagggtttcaccatgttgcccaggctagtctcaaactcctggcctcaagtgatccacttgccacggcctcccaaagtgttgggattacaggcctgagccaccgcactgggcctcagtcagatatattttatgtatactttaaaatcgcacgctattaatgaaaaaattgagcgcttgaggattatctacgtgctagatactttagatacattatctcatttaatagaagtgcaaacaatatccccaatttacagttaagaaaactgagaagcagagaggttaagcattggccaaaaaataacagaaccaggaatttaaacccaaatcatgctctttccagtgtaatatgttttctctttctacttcttatgatcctgtatcaaaatcccactactaaaagagatggcaaggaaatgttcttgacatatgtaaacccaagccaacatcactgaaacatcaaaaagaaccatgccccaaacctctatatagacctcttgctagttgttctgacatcttgttttttttttgtttgtttttatgtagttgtgttgaattcttttttaatatagttgttttgaatagaaagataggaagtgggccgggcgcggtggctcacgtctataatcccagcactttgggaggacgaggcagacgaatcacctgaggtcgggagttcgagatcaacctgaccaacatggagaaaccccatctctactaaaaatacaaaattagccggacgtggtggcacgcgcctgtaatcccagctactcgggaggctgaggcaggagaatcgcttgaaccagggagccggaggttgcggtgagccgagatcgtgccattgcactccagcctgggcaagaagagcgaaacttcgtctcaaataaaataaataaataaataaataaataaataaataaataaatacagataggaagtggtgttcgctctccaacaccaccgccgcctctcgcttgcagagctccacctgaagcagaagggggataacgaaggaggtctctataccatggctcgtacaaggtggactgcccgcaaatctaccggtggtatagcacccaggaagcaactggctacaaaagccacttgtaagagtgcgccctctactggaggggtgaagaaacctcatcgttacagacctggtactgtggcactccgtgaaattagacattatcagaagtccactgaacttctgattcgcaaacttcccttccagcgtctggtgcgagaaatcgctcaggactttaaaacagatctgcgcttccagagggcagctatcggtactttgcaggaggcaagtgaggcctatctagttggcctttttgaagacaccaacctgtgtgctatccatgccacacgtgtaacaattatgccaaaagacatccagctagcacgccacatacgtggagaacgtgtttcagaatacaccatgatgtgaaacatttcattctcaaaaaaaaaaaaaatcttcttcctgttattggtagttctgaacgttagatatttttttttccatggggtcaaaatgtacctaactatatgattgtgagtggaaaaataggggacagaaatcaggtattgacagtttttccattttcatttgtgtttgaatttttaatataaatgtggagacataaagcattaatgcaagttaaaatgtttcagtgaacaagtttcagcggttcaactttataacaattataaatctgttaaatttttctggacaatgccagcatttggattttttttaaacaagttaatttcttatcgacggcaactaaatggtgtttgtagcattttttatcatacagtagattccatccattcactatacttttctaattgagttgtcttacatgcaagtacatgtttttaatgttgtctgtcttctgtgctgttcctgtaagttagctattaaaatacattaaactataaaaaaagaaagataggaagtttaaattggtaacagacagaggttaaagaacaaagaaaatgttgggaagcagggaaggggttaggaaaggagggagttgtgtggctgccgctctacaactcctgaggctagaagtggcatatcaggttgagccccagctttctggggaattcagcttgcatcaaatataataataactaacctacatctagtacttactttgtgccaggcactcttttaagtgctttacatctgttaactcatttaatcctcacaaaaatcctgttttacatgttagaacattgtagcagagagaggctatgattttcattttacagatgaggaaactgaggcacagagaagttgagtagtttatccaaggtcaagctaacaagcagtggagttggagtttaaatttaggattctgcctccagagctgtgttctcacctgccatgatatagagttaacccttgaataacaagagtttgaactgcagatatttttccataaatatattagaacatttttggagattttcaacaattggtaaaaattgcagatgaactgtgtagcctagaaatatcaaaaaacttaagaaaaagttacatatgttatgaatgtataaatatatatataaactagtctattttattattttctaccataaaatacacacaaatctgttataaaaagttaaaatttatcaaaatttacacacccacagaccatacatggtgccattcacagtgaagagaaatgtaaacaaatgtaaagattcagtattaaatcataactgcatgaaattacgtacccacctcctcttgccatggtggtgagctcaagtgttgagagtatctgcttaaaatgccaccatgtgatgctaatcatctccccttgagtggtctgctttaacaataaattgcatatggagataaaaagtgatctctcttgaggctgcagtgagctgtgagcatgccactgcattccagcttgggcaaaagagtgagattctggctcaaaaaagaaaaaaaagccatctctggtagttctcctgtacgtttcaccatgtacatttcatcgtgtttagtgcaatactgtaaaccatgaataacaccgtgggactcacatgaagtgccactactgctgccagaagtgctcctaaaaagcaaagtcatgacattccaacaaaaagttgaattggttaatatgtatcatagattgagatctgcagctgtggttacctgccatttcagacagacgatgtaaaacttagagtactgataaatacagtacaatactgtaaacgtattttatgtttttaaatcatttttttgagacagggtcctactctatcacccaggctgactggagttcagtgacgcctttatggctcaagcaattctcccacctcagccttctgagtagctaggaccacaggtgcatgcaccatcttggctaatttttgtatttttcataaagacgttgtttcagcatgttgcccaggctggtctcgaattcctgggctcaagctatcctcccacctcagccttctgagtagctaggaccacaggtacatgcaccatcctggctaatttttgtatttttcatagagacgttgtttcagcatgttgcccaggctggtctggaactcctgggctcaagcaatcctccctccttggcctcccaaagtgctgggattacaggtgtgagccactgcccctggccttaaaatcattttcttttctgtggcttacttcattgtaggaatacagtatataaaacatacgacatacaaaatatgttaattgattgttatccataagacttctagccaacagcggactattagtatagtcatccctcctctctgtatacatgacagattgattccaggacctcctgcagataccaaagtctgcacatattcaagtcgcgtgcagtctatttttcaaaacccacacatacaaaaagtcagtcctccatgtaagcgggttttgcatcctgagaatactgtatttttgatccatgtttggtgggaaaaaaaaaacgtgtttaagtgggctcgtgaagttcaaacccatgttgttcaaggttgacgtgtagttaagtttttggggagtcaagttataccaaattctgactgcatgggagatgggggggcgagttagcacccctaacccccatgttgttcaagggtcaactgtattgcctcttccaatatgttgtaagaataagtattgtttcagaaaagatttacttcaaggtatatatgcgtgtgtgcttgtgtttgtaatgggtagcaatgtaaaatgtattcatttttgtaagtcacagacaaaagtatctaaaactgctactgctttagcaatagcattgctgaattgtatatcttcaaccttaacagagataatgccagattgctctccaaaattattataccaaatcacactctcaacagcagtgtgagatgttccatatctctctatatagaatctctctatatagaatatctatatagatattctatatattatacctatgttccatatcctcacctgaacttaatagtgccagacttttaatgtgctatcgatccatttaatgtgctatcaatactgggtgttgaatagtatcttaatgttgttttcagttgcgtttttctgatttccagtacatcttttcatacatttgaccatctaaattttgcctattgtgaatcatctgtttatatcccttacttgtatattatacaatacaaccctcacaacagctctctgaaggagccagcagtatagatgaagaaactaagtctgggagaaatgttgcttaaagtaacccagctaatgagtttttgagctgaaatttgagtccagatgtagaggacccgtaaacctatgccttttgttttacactacatgccagggcccaaggtcatgttagaaaaaaaaacagaggaagagcacaaataaatttgaacatgtaaccctatgtcttgtgtctaattaggctttgtgcaattaacatagattatttccttgcttcctcacaacaacctgtgaggtaaaacgtgttatctccattctacagatgagaaaactaaggtgtagggaagtgaagaaatttgtcttggaagggttaaattacagctagaaatttgccttggaaaggttaaattacagctagggacagaattgcaactcaaacacagatctgcctgattaccaagtccacgcctgttccacagtaatgtctgtccatagatactcctggtgtaaggtaaaggcctcccacaaatcaagcctgactcatcatctcctagagccaggtcttgacctgcttccccagtttctctccagatccccatatgtttctacttcggtacggccaggactatacctactatctttctgcagaataatggtctgaggcagccttaaaactggccgagccctgctgcttcacattaaccatctgggctaggttagctcccatagattactcttccccttcctcaggcttctctaatgaagcccaataaggatctcaacaccttccaaggtaaaccagaaaattataagtcagagtccttaaacgtggctgcacattaaaatcacttgtgaacttaaaaaaatcctgatgcactagttacaacccaggcccattacatcagaatggtacccaggcattcataatagttaaagcttcccagatgattccaatctacagccaagattgagaaccactgttacggcatcttcttcaagctccagcagccatactcagtagtttccacattttaggttttcataggaacttcttggagcactggtaaagagccagatttctggacgccatcccagagaatcctggttcagacccaggagtctacattcttaataatcaccccagatagtttcactgcagattattagcagacaatattttgagaaatgctgcattagaggcatggaagtaggatgggaacaggaggcctctggccctttaaggatggattaagggactacttttaaggctgtaggggcaagtaggatcaggctgctttttttcattctagtggataagttaaggaagtgggtcctgaaatggacctctccttttaagttacctgagcctctcaataggtactatcttgttctcagcccgggagagcgggaggggcatgctgccttgtcccaccttctgtttctgtttcttttgatgcaaagaggccaagttatgaggcaactttggtccaggagatcctcttagagaaagcaacatagggcctgcctgcctttctttttcttgccccatccttggttgtggagccaggatgcagttatctgcatgaaaggaaatggtcagagtgacgtcccttgggcttgtgttggggcctgttgttgaacactaagcctttcaagatggtcctcctcagtattcttagaattctttttctttgtgaactcgtgcttttcatggaacacagggcccaaatggcagaaggagggcagtcctctattgcccttctggctgaggcccctactttgcccctgattgaggagctgctagaagaatcccctggcgaacagccaaggaagccccggctcctagggcattcactgcggtacatgctggagttgtaccggcgttcagctgactcgcatgggcaccctagagagaaccgcaccattggggccaccatggtgaggctggtgaagcccttgaccaatgtggcaaggcctcacagaggtgagttgttatgcccccatactgccctggaagggagagaagtggagaggagtgtagagaaaagggaattggtgggtttactgtcaggctttgttgccttgtgggcaggttgtttctttaggcttggttttcaaaggatggcaagctttggagaagccagcgccaagcctacttccctttagggcatcaacttaagaacagattgccttggtgcctactgagaaatctttcccaggccccaggacaactgagtgatgtgccatcacctatctttcacagaaacttttattgcttgtgatagttctgaaaactgtagagacatatccagctatattcttgtggagggctatttaagtggcgttttgctcttagagtacagcttgctgagttggggaaacttataaggcctcagaaaggacataaataagcttacatctgagggtctgtatacctggctctgtgaacatgtgctactgtatttcttaatgaaagctactatcttaactgtcttgatgcaattagcctaattttaaaactaaggcacggagaggttaagtaacttgcaaatggtacacagatagtgggtcgcagagatgggattgcagctgaagtctgtctgattctaaagtctgtcggtaacttcttaagtctttaaatgcagtattccaatatccttgtacccccaatagtttttctacttgggccatattgctactttgggattctgggactaagtgtattttggaacttttttttgtccccatcatgcttgattttgcttttaacatttgcatcagacattgttgcaggacaacagtgggctattgaagtgtaggactctctagagaatgcagacagtcatcaacttcaaggaattcttgggaacctagtgagatcaatctgtagccttcactagtctgagatgaaaagggacaggacttaatcccctccccaagcaaaacaataaatattctcgtacctaacccttactgtgagattactgtgtgccaggcattgcacaaaatgttttataaacattatcttaatcctcacaactaccagattaggtagtattaacatgcctacttgataggtgaagaaactgaggatcagagtcacttacccatgtcatacaaccagtaattgctagagccaggtatcaaacccaggctctcaggcccaaagcctgtgtgttaatcatcttgctgttctgactccccactggattttaattgagtgccaggcagtgtgtttgggttgggtatatagaagcaaatacttttccgacctctagaagttcccagtatagtggaatggatagataattacataataatgttacagtatgccaagtgctttggaaaggacaaacagtagggctcccaggacctatgagaagaaatggctcatttcttgaagtgaagagactgttggaaggcctcatggaggaggtagtacttgaaactgaccttgcagaaggagcaaagaggtcatgcattgaggcagataagtgcattctgatttaggaaagagaaaatggtgtgggtagagattcattgaacaaatattaggtgccaaatgttggcacctactgagtactaggcatacagatgtgatcaagataggtaaaacccctactttcatggaacatatgttctcgtaggggagacaaataagcacacacagttaaattgtgaattgtggtaagtgctatcaaaggatgaagtaggttgttaagatagagaatggcaatgaaaccttccctttccatggacttgtcagggaatgtatctttgaagaagtgccatttgagctcaggtctataagataaactaggcatgagaagagtagggagaagcctgatttaggcagaggaacaacaggtgcaaatgcctagagggtgaaaacaagttggttccaattgaagaacagaggaaaatcagtatggctggatcctcatgagcattgtgggaaatggcagggtatgaggctaatgagaagcagggacttgtaggctgtgataagggatctggatcctaagagcagcagaaagttgcaaaaaatcaagcactttgggaggccaatatgggaagatcacttgagcccaggagactgagaccagcctgagcaacacagggagacatgtctctacaaaaaataaaaatacattagctgggtgtagtggtgcacacctgtggtcccagctactcacgaggctgagaccagaggatcatttgagcctgggaggttgagactagaggaacatttgagcctgggaggttgagattgcagtgaggcatgattgtgccactgcactccagcctgggtgacagtgaggccctgtctcaaggaaaaaaaacaacaaccccacaaattaagaaaaaattaggcttgtacagatgatgtgaggctagaaaggaggatgcctagaattagacatgtatcctggtctcactgtggaatatactggtatctagggactgtggaaaggatccagagacagatgacaggttcaatcacacaggatgtgtgattcagccctttccctgaaaagctttgaccagacccttcctggctctgattcttagcaaccccatcctgcttcaggaaacatgtgatgtcaaggtctcaaagaaaagggcagttcctccccagacagcctgctagaggtttgggttgagttcctttatagccagggtggagcaggtttaagggtgggcctctaagaaagattactgtaagatgggagtgtggaataacttgagaaagcaaatacaagcctggcttggatttgtgtgaataatgtctagtgcgccaagcccaagggtatattaagcatgagttggaatttgaccttttattttacttatttttttgagatggagtttcgctcttatcatccaggctggagtgcagtggcacaaactcggctcactacaacctctgcctcccgggtgcacgccattctcctgcctcagcctcccgagtagctgggattacaggtgcctgccaccacgcccggctaattttttgtatttttagtagaggcagggtgtcaccatgttggccaggctggtctcaaactcctgacctcaggtgatccgcccgcctcagactcccaaagtgctgggattagaggcgtgagccaccgcgcccagccggaatttgaacttttaaagatattctggggctgggtgcagtggctcaaagggcggctaatccctgcactttgggaggccaaagggggcagatcgcttgaacccaggagttcgagaccagcccggcaacatggcaaaaccctgtctctacaaaaaacaaaacagaaaaagctgggcatgttggcacatacctgtagtccttgctatccatgggggctgaggtgagaggatctcttgaacctgggaagtcaaggctgtagtgagccatgattgtgccactgtactccagcctgggtgacagagggagactctggaaaaaaaaattctggaacatcaagatgtaaaagaacttctgtgttaaaaatgccacatctaatgaagaattccaggcttgtggattcagtggagaagaaggactaggtgaataaatacaaattaacatggaattatttactgataagatgtctgaagatgagaggtggctttttcctgtggtgccaggcttttgtaatctttgctcttgaccttcgccgggagggggtgcagaagtttggagcaccatggatgtaacctttcaatcctttggccgttgagtgtcagcactacagtttggattaaagctcttattcacaaagcagcatccagcttttagtagacttctcagcaaacaaaatatttatgtgatcaagactgtgttgaaaatagtatatagaggaatagtggtaaaatgaatggggtaaatggagaacaatttccagcaaggagtggtaaagagagagattaagggccaaaggaggaaaagatgcttaagaagcaattcttgaagtagatggaaggcagaagtggtaagatagctgtctgtactagaggatgatagacaaaattattttgtagtgccttggtcctgagtttgaaattatagcaggccatagcacccaatactgaattgttgtcccaaagctgcatctgtatagtgatatgacatgagactctttcttaatccatgtatgtttcaacaattctaaatggacacatttaatggtcaactaataataatattgatcttctcccctacatacagtatgcacacaagataattctatatttgagttttttcccccgagcccagcactgtaagtaatctaacagtgagacagtttctcttaagaaaaacagacttgggttcaaatcttaactctaccacataccagctgtgtgtcctttgtcatagcttctctgagcctcaatttccttatctgcaaaatggggataataactatctcataagactattaagaattaaagagctaatacatgtaaagcatctagtgtattagtaagtgctcagtaaatgatagtatcattatcttgagttaattttagggctgattatagctatcagtctatatcaagacagtttatgaggaatattcatgttaagaggtaagaagctaaacctctgctcttgttccctcttacttctgcaggtacctggcatatacagatcctgggctttcctctcagaccaaaccgaggactataccaactagttagagccactgtggtttaccgccatcatctccaactaactcgcttcaatctctcctgccatgtggagccctgggtgcagaaaaacccaaccaaccacttcccttcctcagaaggagattcctcaaaaccttccctgatgtctaacgcttggaaagagatggatatcacacaacttgttcagcaaaggttctggaataacaagggacacaggatcctacgactccgttttatgtgtcagcagcaaaaagatagtggtggtcttgagctctggcatggcacttcatccttggacattgccttcttgttactctatttcaatgatactcataaaagcattcggaaggctaaatttcttcccaggggcatggaggagttcatggaaagggaatctcttctccggagaacccgacaagcagatggtatctcagctgaggttactgcctcttcctcaaaacatagcgggcctgaaaataaccagtgttccctccaccctttccaaatcagcttccgccagctgggttgggatcactggatcattgctccccctttctacaccccaaactactgtaaaggaacttgtctccgagtactacgcgatggtctcaattcccccaatcacgccattattcagaaccttatcaatcagttggtggaccagagtgtcccccggccctcctgtgtcccgtataagtatgttccaattagtgtccttatgattgaggcaaatgggagtattttgtacaaggagtatgagggtatgattgctgagtcttgtacatgcagatgacagcaacagtacggctagatcaggtttcccaggaaactggaggagagtttaaaatatcagtgttaaagctgcaagtaatcctgtaccaatctgtaggttatatttcttgccttaagtgttacttaagtctcttcccccacttgtgagctagtcagtttatagaaacagttctgataccagtcccctagcatgaatcagtacagtttgaccactaatcagagcccttaatgcttgggtaaaatgtcctctattttactttccttggggctttgtcaaaagtcagcagtcagtagtggtagaacttcagaaattttccaacttttcccagcctgggaaaggtgggtgtccatattttcctagtgtccatattctgacgctctataagatttggggtggtgaaaatagcttgggattttatactcctcttcttgcctcctatgtcctggaaactactagtagctaatcagataaattgcctgcttctgtgttagtattaccttctaaaacttttctcagactggaaatttttcaggtaacagtctttatagaaatcttttgagggactagaaggaaggaaatgtttttctaaaccagcagggcttttcctcttagcctctgaatctgggaaaagtatctgggattatttcctgtcctaggtgagtacagtagcatttaatgaagcccataaggaaactagagtatggagctgtctgagataatctacttcaaacctgcatttatggtgaagaagagaaaacctgtcattgctgattagtattatgaatgggggagttattttaagtattctatggaacaatagagttcagagtattttccttatgtgacacttaaacccctgtaaattatcctacaaagttccttggtggctccgaggctaggagttggcctgattgggggtgcaggggattagagggctgtgaaggaaggactacagaataagggtgaaacctgccaaggcctggagctgactttattctgggcttgcctgtttcttgtgttcagtttggatctggaccggggtctctaagggagaagggcttgttgtctttgggagacatggaacgatgccttgaaataaatgatgcttgcagtgtgactcctttctactcctatactgtatttaaatgacgggactgggttttgttgcaaataaatcatttcactgttgaagaaaatcttgactgtttttagaattgggagagattggaaggaatttatttcctttgttccctttagctatggctaggaattcaaccctaatccctgaggggcagggctggagcgtcctctgaagttcttctctcttaaggaaacactgctagccatcagccctcgccaaggtgcccctttagggaagcccctaaggggccagtaagtctttccctgcccaattgctcttgactagtcttatggcaattctcatgggatgggactgatttagggtaggtatgtgtgtttgtcaaatccctacgtttcttacctattcattgtaaactaactccttttaccactcccttcaaaagctggttccaactaggctgaatatcttgcaagtgtataaatgcaaattttattcttgtgactgaggagctattccttaacatcagtttgcctgtctaccttctttactgtatccttaagaatcaactcaggcatttctcatcttctcaatgtccccttgacataccagcctcaggtgtgtattaagtttcctatgtattcagacctcacaaagctaggagatcatgacttattgaaaatccctaagatccaagatgctaaacttaggatctggtcttataaccaaggtccatcttcagctagactgaatattttgcaagtctctaggtgtccctctgtgttcatatagcactttatacctgcctttaatacgctctagtatatatgtctattcttacaaaaacacggagccccttttgagtttcaactgcatcttacccttttctatattataagagcctggcatctagtaggtccttaatgaatacaaacactcaattatgacatttttttgtgagtgatgcattcttcctgacatggaacatctcaattttcacatattttatttttccatgggaatcaatgtaatataaaatagtttgtgtatcaagtaagatgattattatatcctactatttcaaaatcatgatttaaattataatagaatgtaatagctatgttaagtaaggcagttcttgtaatcattatatatgctgcagatttatctgggaggggaactatgggcttccagtctagccatttctccagcctacttggggtaggcacaaatatctaacaggcctgaagatggacctcgattataggaccagatcctgagttcagcatctttgttcttagggattttcagaaagtcatgatctcctagccttgtgagtgctgaatacataggaaacttaatctgtttatggaaggttcaggattaattggccctattatccattaagccctgagttatcagaatacccaagaaaaacactggcaggatggggttacttaggatgatgttatggattcttcctttgaaatattgcttcagttcagtactttttctcaaatccaaagttagagttctatacctcaaaccttcctctgagaggaagaatacatgcttgctagtggaggagggtgcgtgggtgggggtggggcctgtctgcccatgtaggtggggagaaatggttacttgatctggaaagggaaagtaggaagcaagtccacatagtcccaacaatcccaatgagtaagctggaacttcatttaatgtatgggtgcaaaaggagcaggagcaggcatttaaacttgtgtctgatcgtggatctcttttgcatttaccttggtagtatgtcacaaccaattctgggcaaagttgggaagcaggcagaacttcagttacacaaactatttggcctaatcttgtaaaacatttcatgtcttcagttaattctcccaagagcactatgaagtaggaggtattagtcttattttctaaaaactgcctcattgaggtgtaatttaccataaaagctactatttaaggtgtacaattcagtggtttttagtatattcacagacttgtgtaaatatcaccacaatctaatttcaccacaaaagaaacctcatgccttttagtggtcaatccccattcccccaacctttaccaacagctcctgacaaccactagtctactttctttttctctggattatggacatttaaataaatagaatcacatgatatttagtttttgtaactggctgctttagtatgttttcaagattcacctgtgttatagcatatatccatactttgtttctttttgttactgaataatattctattgtaggatataccaaacctttatccatcaatctgatggaagttcaagtttctatgttttgactattatgaataatcttgccatgaatgttcatgagaagtttttgtgtagacacatattttcattcctcttgtgtatacacctaggagtagaaatggtatatcatatggtatatttaacattttaaggaactgcaaaactattttccaaagtggctgcactcttttataatccagcaatgtatgagagtaccaatttctccacatcctcatcaacagtcattattgtctgtgttttatattctagccatattggtggaagtgaaatggtgcctccttgtggttttgatttgcatttccctaaggattaatgatgtggagcatcttttcatgtgcttattggcaactggcacatcatctttggataaatgtctattcaaaccatttgcccagtttaaaattgtgttgtctcttgttgtgttgtaaaagttcttcatatgttttggatattaatctcttatcagagctatgatacacaaatattttctgattctgtggattatttaactttcttgatggtgttctttgaacacaaaagtttttaatttggaagaagccctgtttatctatttttatctattgctgcttgtgcttctggtatcattggagaaaaatcgaataatccaagtgtcatgaaaatttacgcctatgtttttttctaagtgttttctagttttagctgttatatttaggttttaaatctattttagttaatttttgcatactgtgtgaggtaaaagtccaacttcattcttttgcatgtggttatatagttgtcctggcatcatttattgaaaagattaatctttctccattgtcttggcacatgtgtaaaaaatgaccataaatataagtttatttctgtactctcaagtttattccattgatccatatgtctattatgccaggacaatactgtctttataattgtagatatgtcgtaagttgtgaaattggaaagtgttggctgggagtggtggttcacacctgtaatctcagcacttaaggaggccaagacaggtagatcacttgaggccaggagttcaagaccagcctggacaacatggtgaaactttgtctctacttaaaaaaaaaaatacaaaaattagccgagtatggtggcgcacaactgtaatcccagctactggggaggctgaggcatgagaatggcttgaacctgggaggcagaggttgcagtgagctgagatcatgccactgcactttagcctgggtaatggagtgagaccctgtctcaaaaacaaaaacaaaacaaaaaaattggaaagtgtgattcttccaaatattttattctttagcaagattgttttggctattctgagtcacttgtatttccatattaattttagggtcaactcttcaatttctacaaaaataccagccggatttctttgatgggggctacattgaatctactgacaaatttgaatagtattgccattttgacgttaagtcttctgatctgtaaacatgagacatctttttatttagggactctaactttttcaatgatgttttaacattttcagtagatgtcttacttaaatttattcctaagcttttaaaattatttttgatgatattataaatggaattgttttctacattttgttaaatcagactgtttattactaatttgtagaaatacaattcatttttttgtgttgaatttataccctgcagacctgctgaactcatttattacatctaatagtttgtgtagatttcttaggattttctgtaaacaagtttatatcatctgggaatgtggatagttttactttctttctttccaaactagataccttttattcttgcctaattgctttggctagaacttccaatacaacattgaatagaagttgtgagagcagacattcttttcttgttcttgatcttgagtgaaagcattcagtctttcatcattaattatgatgttagctgtggtttactatagatatgtgactaatacttactttaaagttacagtaatcaaggtattgtagtattggggaaagaataaacacatagatcaatggaacagaatagaaaacccaaaaaatagatccacacaaatgcagtcaattaatctttgacaaaggagcaaaggcaattcaacagataaagagtaattttttcaacaaatagtgctagaacaaaaacaaatctagacaaagaccttatactttcaataagagtttattgaaaattgatcatagatataaatgtcaaacacaaactataaaacttctagaagataacataggagaaaatataaataactttgagttatgtgatgacttttctgagacaaaaccaaaagcattatctaaaaaagcaaaaataagttgggctttgttaaaattaaagcttctgttgtgtgaaagactgttaagaatatgaaaagataagccacagactgaaaaaaaattgcaaaacatattagataaggggcttgtatctaaaatatacaaagaactctgaaaactcaacagtaagaaaatcaattaaaaatggggaaaacatatgaacaaacacctcaaaaaataaaaggcatgggctgggcacagtggctcacgcctgtaatcccagcactttgggaggctgaggtgggtggatcacgaggtcaggagttcaagaccagcctggccaatatggtgaaaccccgtctctactaaaaatacaaaaattagccgggcatggtggcacgcatctgtagtcccagctaatcgggaggctgaggcagaagaatcactggaacccaggaagtggaggtggcagtgagccaagatcatgccactgcactccagcctacatgacagagtgagactccatctcaaaaaaaaggcatatatgtggcaataagcatatgaaaagatgctcaacaacatatatcattaaaacaatgaggtaccactgcacacctattagactagctaaaacccaaaatactgatatcaaatgatggtgaggatatggagaaacaggaactctcattcattgctggtgggaatacaaaatggtgtagccactctggcagacagtctggcagttttataaaactacagtctcatcatacaatctggcaatcacatttcttgatacttatttgagttaaacttatgttcatacaaaaacctgcgcacaaatgtttatagcagatttattcataattgccaaaacttggaagtaaccaagatattctttaatgggtaaatgaaaaacaaactgtggtacatgtatacaatgggatataattcagcaataaaaagaaaatggctatcaagccatgagaagatatagaagagccttgactggatattgctaaatggaagaagccagtttgaaaaggctatatactgtatggttccgttcatatgacattcagagaaaaggcaaaactataaaagatcaatggtttccatgggtttgctgggagggaggcgtggagcatggggcatatttagggcagtgaaactcttctgcatgattccataatagattcatgttatgtatttgtcaagacccatagaactgtacaactgaaagaatgaacactaatgtaaactatggccttcagttaataatgtgtcaatactggttcatcaattataacaaatgtgccacaccagtgaaaaatgttaataacaggagaaagctgaaagatgtgttggggagaaaaaggtatatgggaatgctctgtacttttaagtttttattcttaaattgacaaagttgcatgcaatataccatgtacaacatgacttgaaatatacaccgtggaagaactaaatcaagctaatttaacatgtgttaccggccaggtgcggtggctcatgcctgtaatcccagcactttgggaggccgaggcgggtggatcatgaggtcaggagtttgagaccagcctggcccacatggtgaaaccccgtctctactgaaaaatacaaaaaattagccgggcatggtggcacgcacctgtaatcccagctacttgggaggccgaggcaggagaatcacttgaaccagggaggcagaggttgcagtgagccgagatcatgccattgcactccagcctgggtgacagagtgagactccatctcaaaaatgaaaaataaaaaaaaataaaaaaaaatatgtattacctcacgtaatacttttgtggtgagaatacaaaatctcttagcattttcaagaatacaatgtattgctattaactatagtcagcatgttatggactagatctcctaaaattactgctatctaactgaaattttttattctttgttcaacacctcccaccccagctgctggtaaccactattttattctctgtttctgtaagttcaactccttttttagattccatgtgtaagtgagatcatgcagtatttggctttcttacctggctcatttcactgagcataatgtcctccatcctccaggttcatctgcattatcacaaatgacgagatttcttttttatggctgaatagtattccactgtgtatatatatcacattttcttttttttatattatactttaagttctggggtacatgtgcagaatgtgcaggtttgttacatatgtatacatatgccatggtggtttgctgcacccatcaacccatcatctacattaggtatttctcctaatgctatccctcccctagccccccacccccaaacaggcctcagtgtgtgatgttcccctccctgtgtccatgtgttctcattgttcaactcccacttatgagtgagaacatgcagtgtttggttttctgttcttgtgttaccttgctgagaatgatggtgtccagcttcatccatgtccctgcgaaggacatgaactcattctttttttatggctgcatagtattccatggtgtatatgtgccacattttctttatccagtctatcattgatgggcatttggtttggttccaagtctttgctattgtgaacagtgccacaataaacatacgtgtgcatgtgtctttataatagaatgatttataatcctttgggtatatacccagtaatgggattgctgggtcaaatggtatttctagttctggatccttgaggaattgccacactgtcttctacaatggttgaactaatttacactcccaccaacagtgtaaaagcattcctatttctccacatcctctacagcatctgttgttgaaaaaaggttaaagcatataccacattttctttatctattcatccattgatggacacttgggttgattccatattttggctactgtgaataatactgcaataaatatgggagcgcagatatctcttgaacatattgagttcatttcatttggatatatatccagtagtggaatttttggatcatatggtagttctctttttaatcttttgaggaaccaccatactattttccataatgagtgtaataatttacattcccaccaacagtgtgcaagggttactttttgtccacatccttgtcaacactttatcctttgtcttttaaaaaaaatattgtaaattgaaaattgattgctgcatatatttatggggtacaacatggtataatttataaatataacatgaaatgattaaatccagctaattagcatctctatgatcacaaataccactttttgtggtgaaaacattaaatttactctcctagaaattttgaaatgtacagtaccatgcatagtgaatattaactttattaactatactttattaaatatattcaccatgctgtgcaatagatctcaaacaccttatttcttttgcctgatattttgtagcctttgactatcatctctccagcatccccacccctgagtctcggtaaccaccattctactttgtatctatgagttcaattgttttagattctacatacaagtgaaatcacatggtgtttgtctttctgtacctggcttatttcacttagcataattttctccaatcccatccatattgttgaaaatgacaatttccttatttttgcagactgaatagtattccattgtgtacatatactacattttctttatccattcatcgctgatggacacttaggttgattccataacttggctattgtaagtagccaataaacatgggaatgcagatatcttccacaaactgatttcaaatattttgggtaaatacccagaaatgggattgctgcatcatatggtgtattagtatggtcttacactgctataaagaactacctgagactgtgcaatttataaaaataaaaaaaagacatttaattgactcacagttccacaggctgtacaggaggcatggctggcgaggcctccagaaacccacaatcgtagcagaagggtgaaggggaagcaagcacgttttcacaaggctgcaagagagagagctaagggggaagtgctacacacttttaaacaaccaaatctcgtgagaactcactatcacaagaagaacaagggggaaatctgatgccatgatccaatcacctcccaccaggtccctcccccaacaatggggattacaactcaacatgagattttggtggagacacagagccaaaccatatcatatggtacttcttctacttttagtttttcgaagaacctccatacggttttccataatgactatactaatttatattcccactaaccatgtacaagtagtctcttttcttcactcccttgccaacactctatcttttgtcattttgataatagccatcttgacacgtgtgatatcttactatggttttgatttgcattttgctgataatagtgatactgagaattttttcatataccttttggccattttatgtcttctttggagaaatgtctgttcaggctctttgcccattttttaatcaggttatttgttttcttgctgttgaattgtgttccttgtatattttgaatattaacctcttatcagatatgtggattggagcaggcctatatcctggcgttatgggggctgacacagctctgggctagtctaaaacatggaacaggcttgtggcctatgtgttcaggggctggcctggaggatgggtttattggtgctggcctgaagactagggctgtggatgctgtcctgtgctagggtgctgggtgaagtttgaggcctagagtcctgggattggctttggccctggatgtgcctggagactgggtctgaggggggcttgcctggcactggtgtgggcccaaagcctggtgctggcttggcactgagggtggtccagagcctggggccactgaggtttgcctggcagtagggaaaaccagagattcagtctaccataccagcctggagtctggggttgtagtgtccagcctggtgctggggcaagcctagaaacttagtccatgggtattggcctggggcctggagctgtggagtctgcctgttgctgggctttactgtggcagatctagtgttggcatccaaagttaagtctgatgctcacttttctctctttcacccaagcaaaggatatctctttccacactctgatgactgtagttgggagagcggtgactcaggtaatgtaaaactgtcccctttttaggaatggatattgtgtagtcaaaaactttggggctgagaccatggggaaagtagacagaaccatgaagggagataaactgcttgtgttgagcaattcatttgttgtctcttgtttctgtaccagtaggcctaaataagtattggcataattgatttttttgggttatagtatattttattgtatattactaaaaagatatacactttatatcaagctgggtatggctgagaataatatgtgaccaggaggagagacaaccatcagtgctgttactatgtgttcattgttccctaggcctgtcctatatgtttcttactagcagtaggacttgtcaagacagcattacaataaatggggaattattttacttagcctgggccacatatcagccatggggggaatgtgatcccgtatctacaaaataatgtttaaatgttatcttggtgtggtattgcatgcctgtagtcatagatattcaggaagctgagatgaggagattgcttgagcccagaagtttgaggccgaagtgagctatgatcacaccactacactccagcgtgagcgacagagcaaggccctgtcacaaaaaagaagaaaaagaaagaagaaatgaaggagaaggaggaggctctgactttgaggagagttcagtgtaacaaggtagaagaaatgttttttgttgttgttccttcatctcacccttccacttagtacacacacatgcattgtgtctgtcaacagctgggcagtgctgagaagaaggactgtgcttcctatggacattctctagacctgtacatttaacatcagctcacaaattttcctatcccacaggaatgcagaacccttgcatcatatggcgcatctccctgcctttctccattcaccacaggtcttacattttccaataacataaggattatttttctctttctagagtatacacacactgtggtcttctcatcttttacatcccctcataaacccggagtgagcacgttattaggaaggatccctgtgtataaattccctacttcttactattttcttatatcccagtggtccaaaaccaaaaattataccctctcttatcatcctcataagaatgataataggcagcatgtatcaaatgcttattaatcaggtaatgttttaaataatttacaagtattatattgtttattccctgcagccactttataaggtggctcttattattacctctgttctgcagatgtagaactgaagcccagaggtcacatagccggcacaaggtcattagctgataagggatggcaccagaatttgagtcccagtggtctgacttcagagtccctgctcttaaccacgatactattatgcctcccatagctggacacagagttgttttacaattgatatctgttgtaaaattgttccctaaagtgtacactgtctctgactctatggaatgactgcatgcaacgatgagatataatctgtgttagttgtctattgctgcctaaagaattaccccaagacctagtggcttaaaacaatatttaccatcttagtttctacagatcaagaatttgggcacagcttagtagggtgcctctggctttgggtccctcacgagggtgcattaaaaaataaattactttcaaaataataaaagtaatgcatatgcctagttaaatatcccaatagtactaaaaatataaaatcctactgtccagaggcagtctctattaccaatttattgtgtatccttccagaactcttgtataaacttacacatatgtagctgaactgttttctaaatctctgtaattattagtttattagtatcatctaggcctcagatgttcattatccctcctgaaattacataaacaaatgtaaatgaaaataatccaagtcaaaattgtataacaaaatagcactccatcacaaaagcatgtaaaattacaagaatgttattttaaaatactggcactttaagaaaatgataatatcaaaataaacaaaatttccaaattgttccctaaactgctaagcagataaacatgactaatgaatgagtttgggttttgtaaagaaaaattatttaaataaatcaaataattcatactgagttgcaaaggttgtatcttctttcctcctatctatttgatttataaaggggcaagctgtaatataggaaaatgtaacctattttaaacgtggcatcttcattttaaaagctggtccaattaattaaaaatactttttatggagagttttgagtttcctgagcagttcatatttagataaatgggaaaagacatctacagccagcattttcatagtctttactagtatcaaccaaaaatttaatatggcagtcttatattttaagctcacaccttttggggatacagtctcaagtcttcttgaatgtcagaactgcaaaatacaattgccgttatatggtaatgggagttaaagaacatagagtcctcatgtaaagattagaacacacttttctatttagtgcttcaaaggacggactttcaaaatgtttgatcttaataatcccatgctgtgagtagactgattactcttcagtttgtaaatataagtgggctatgtgaaatttatcaactgattaagatttttgagcttcagttatggatgacgatgatctcaatttaactttatttacccccatcatgatatgcagggtgtgtagacaaaagcattttatcagctacctatatgagaggatcaacactgtaataattcatgtgatccaaaatgggcaaaagcaaaagactagcttcccttcaagaagaaaaatttcagacctatgaaaaggactacaatactaattttaaaaactgtattagaagcattcataatgtcagcaaaattgctacaacttttttgcaattagtgtgatattcagttaacagaacaactatttcatataagctgcaccagagacaactgaagatgaaaaaattaccatccccgtatataactaatttgtgctgtgcaccaacaagaacctgctttaaattcccatgccaatttacaacccctataccataccaggcagtttgtggccatctaaagacacatttggtagtgggataactacacacacacacacaaaaagacactgtaaggtttaaaaacaaattatgtacagcttatagtttaatttttttcctttaaaagcagtgagttgtgtacagggggcttaaatgttttatagacaataaacaaatggctagaaccaacttattcatcattattacctttttaattttcatattcctcattttgtcctcttccttctttttcttgcatttttcagccttgatggctcccttttttgcagcatcaggttttcctttacctccaaatgcagcaatatccttttcatatttttccttcagcttcacagccttcttttcataagggtgcttgtcatcttcagcaatgtaattccacatctctcccagtttttttgcaacatcactaattgataggccaggatgttctttgatttttgggcaatcctcagaagagaacatgaaaaaggccaaaggagggctcttgggtgcattgggatcttcgaacttcattttggtctctgcttttggagggatatagattttcatttctctttcataatgggccatgtccacctttactgagtcttcaaattttcatttcttttcagcagacaaggtcttccacctctctgagcacttcttaggaaactctgagaagttgactgaagcatctgggtgctgcttcttgtgctcctcccaggaagtttgcacaaagattgcatatgatgtgatgacatttcgcctttcagcttgttaggatctcctttgcctatgttatttttcttcagcaaggcagaatcacccagtgcctgtttggctctcacctgccctggagctgtctctatggagctcaatgtactgcagtggctgtgagagtgggagccagatgcagcctcctcgctctctccactctgtaacctgaactttttcttaaaaccaatggaatcactcatgttgctttgcacagtctcttcttaacttgttcattaacaacatgttcaatacatataggcccacctcattccatagttgttctaatgattgctttttcctgaggcctaaacaaagaagatagctagagttggaactcactttcctcatttatacaatgagaaaaataacaaatcttaagcttattaataatactgttatgaagattaagccaatgcatgtaaggtatttagaatggtgtctcacatatagtaagcatgaaataagtattgacatttcttgttagttttttcaaccttccaatccaaggaatgagactgactcacatttaaaaataatgagtccaatccagatattagaatagtgataatagcagcagctaacacttatctggcacaatacatgccatgagttgttataaaatctttgtgtgtgcaaacatacctcattttatagcactttactttattgcatgtcacagacactgcgttttttacatattgaaagtttgtgggaactctgtatcaagcaagtatatttgtgtcatttttccagtagcatgtgcttacttcatgtctctgtcacaatttggtaattagtggaatatttcaaagtttttcattattatgtctgttatgatgatctgttatcagtgatctttgatgttactattgtaattgattcagggtaccataaactgtacccatataagacagtgaacttaataaatgtatgtgttctgactgctccaactgatcatttccccatctctcttcctcttctcaggactccctacttcctgagacacaatgatattaaaattaagccaatgaataaccctacagtggcccccaagtgttcaagtggaaggaagagaatcacgtttcttaccttaaatcaaaagctagacatgattaagcttagtgaaggaggcctatcaaaagccaagataggccaaaaactaggcctctggcatcaaagaataagccaagtagtgaatgcaaaggaaaagttattgaagaaaattaaaagtactactccagtgaacatatgaatgataaaaaagcaaaacagctttattgctgatatgaagaaattttgaatgtctggatagaagatcaaacaagccacagcattctcttaagccaaagcctaacccagagcaaggcatggactctattcaattttaggaaggctgagaaaggtaaggactctgcagaagaaaagtgagaagaggttgactcattaggtttaaggaaagaaaccatctccttaaaataaaagtgcaaggtgaaggagtaagtgctgatggagaagctgcagcaaattatccaaaagatctggctaagattattgatgaagatcgctacattaaataacagatttttaacatcgaccaaaaagccttatattggaagaagatgccatctaggtctttcatagctagagaggaatcaatgcctggcttcaaagcttcaaaggacaggctgactctttcattaggggctaatgcagctggtgactttaagttgaagccagtgcttatttaccattccaaaaatcctagggcccttgagaattatgcaaaatctactttgcctgcgctctgtaagtggaacaacaaagcctttatgatagcacatctgtttatagcatagtttactgaatattttaagcctactgttgagaactactgctcagaaaaaaagattcctttcaaagtattagtgctcattgacaatgcacctggtcatgcaagggctctatggagatgtacaaggggattcatgttattgtcatgcctgctaacacaatatgattctgcggcccatagatcagcagtaattttgactttcaatcttattatttaagaaacacatatagctaccatagatagtgattcctctgatggatctgagcaaagtaaattgaaaaccttctggaaagaattcaccattttagatgccattaagaacattcatgattcattggaggaggtcaaaatattaacattaacaggagtttggaagaagttgatttcaacccttgtggatgactttgagcagtttaagacttctgtggagaaagtaactgaagatgtagcaaaacagcaagagattagaattaaaagtggagcctgaagatgtcactgaattgctgcaatctcatgatcaaacttgaatggatgaggagtcacttcttatggataagcaaataaagtggtttcttgagaagtggaatctactcctggtgaagatcctgtgaacattattaaaataacagaaaatgatttagaatattacataaacttagttggtatagcaatagcaggatttcagaggattcactccaaattttagaaggaatgtgggtaaaatgctatcaaacaccatctcatgctacagagaaatcttctgtgaaagaaatagtcgatgtggcaaacttctttattgtttattgtaagaaattgccacaggcatcccagccttcagcaaccaccactctgatcagtcagcagccatcaacattgaggcaagacacttcatctccacaatgattacaacttactgaaggctcaggtgattgtgagcattttttttttagcaataaagtatttcttaattaaggtatgtacattgtttgttaaagataatgctattgtatacttaattggctacagtattagtataaacataccttttatatgggcagggaagccaaaaaatttgtgtggcttgctttgctgaaatattcactttattgtggtggtctggaaccaaacctgtaatatctccaaggtaggcctgtattaagactttaaatcctcataaacgccctatgtggtaaattcgatctttctcactttacagatgagaaaactgagatacagagtgatgagctgtgatcaccatgccaagttggaagagatggtactttattgggctttcatcaagattccttctatgtgagctgttgctgaccatgctctttacatttctgtctggtagaagatcctcttccaatccaaggggattataatatcacttttgggagggctgcaagtcccaaacgggtaccaaaaaagctgagaaataagtacaggcaaccaggttattgttcagattcctgtattcctatgttactaggatgcctaggtccttgagtgatattactaagaaataaatggcgggcctccgtgacttattggttttgagggagaaaataagaccaaggtagaattgaattttgtaccctgtatagtaccacctctaaatacatgaaacccagagcacaaaatggtcctgtggggtcaatgatgaatttgtctttggttgtatgaagtttaaggtactggtaagatgtctaggaataaaggtgtttctggtggttaaaataccaatctaggatgtagaagataagtcagaactggaaatacctgataaatgaagctgtggaggtatatgaaaccatagttaaagagagttattagaaggtagctaaatgtggagcatcagacgggggtctgcatttaagaagggactgagtaccaatgttgaatgctgctgacaagttgtgaagaagagcggtgaggactgaagaaaaatgattatgttttattaagaagtttaaaatggtgggaataaaacctagattatgagacattgaagagtgaggaagatgtggaagtagatgcattagtatggataattatttcctgatactctaattatcttcatagtatttgcccatacctgacaagttatacttctgtttgtttgttgtttgaatcccactagcaactaaggcagggagttttgtctgttttgttcataaatatatccagtatatctagaacagttcctggcaaatagataacagccctcaacagatatctggtgaatgaatgtagtaagtttggtagataagaaatggagaaaggtgatgtgttaattaaaatgtggtatagataaaacagggtcatttttggccaacattttaatatgaacattcttcttttttggagacagggtctcactctgtcatccaagctgaagtgcagtgtcatgatcacggcctcaatttcctggtctcaagcaatcctcctgcctcagcctcccaagtagctgggactacacacatgtgtcaccatgcttggttaattttttttttaatttttggaagagatggggtcttgctatgttgcccaaactggtcttgaactcctggcctcaaatgatcctcctatcttgactaatatgaacattcttaaacatacagaaaagttgaaagaatgataaattgaatatccataagctcactacctagattctaccaacaatgtttttcaatatttgctttattagatatccatctctctttcatccttctgtccattcaacagtccaacttattttgattcatttcaaagaaagttgcatatcagaatacttcaactctggatattctggtatgcatgtaattaactagagatcaatatttatatgtgctttattctttcttcaggtaaaatttatgtcaagtgagatgcgcaactcacaactgtactattgacaaattttaacaaatacatacacctctataactcaaggctctattaacatatagaatataccatgatttagaaggttttttttttggttcttattttataaaggttcacgtatcttaaaattcatcaacactgaaatgtataatttagtgttttttagtgtattcaaagagttgtgcaaccatcaccactatttccagaacatttttgttaccccaaaaggaaactcatatccattggtagtcaatccccatttccccttcccttcagcccctggcaaacactattatgcttttagtctctatggatttgcctgttctggttatttcatatacatggaatcatataaagtgtgttgccttttgtttctggcttctttcacttaccataatatttttaaggttcatttatgtttaagtatatatcagtactttattccttttggttactgaacaagattccattgtatagatatgccatattttttaatcctttcattggttgatggactttttcttctactttttggctattgtaaatcatgctgctataaaaattcatgtattagtatttgttttaacatatgcatttatttctcctgagtatatactatatacctcataacagaactgctaggtcatatggtaactccattcttaaattatgaggaactataaaagcgtattccaaagcagctgcatcattatacattcccaatagaaatgcatgaagatccttatttctccatatcctcacaaattttcttgttgtctgtctttttattttagccgtactggtggaggcgaagtggtattttattgtggtttttggttcacatttcccaaatgaataatgaagctgagtttctttccctgtgcttattggtcatttgtataacttcttttgagaaaaatctatacagatcctttgtccatttttaattgggttatttatcttttattattgagttgtaagaatgctttacatattttagatactagatcattatctgatattatttataaatattttctctcattccatgggtttttgtcttgtgtatctttatggcacacacatttttaatgtaatgtagtctatccaacttattttttctttagttgcttgtatttttatgtcatatctaaaaatctattaccttatctaaggttacaaaggtttaccactatgttttttctaggttgtatagttttaggttcaatatttaggtttatgatccactttcagttaatttctatacagaatgtaaggtaggggtccaaattcactctttccatgtggatatctagttgtcccagcactattttttgaaaagacagatctttctttcctttttttgttttttgagacagagtcttgctctgtcgcccaggctggagtgcagtggcatgatctcggctcactgcaagctccgcctcccgggttcacgccattctcctgcctcagcctcctgagtagctgggactacaggtgcccgccaccacatccggctaaattttttttaatttttagtagagacagggtttcactgtgttagccaggatggtcttgctctcctgaccttgtgatctgcccacctcgacctcccaaagtgctgggattacaggcgtgagccaccgcgcctggtggaaaagacagatctttcacacattgaatggtcaggtcacccttgttgaaaatcagtttactatatgagtttatttctggactttcaattgtattacattatctatatgtctatccatgttccattaacatacaatcttgaatattgtagcttggtagtaagttttaaaattgggaagtgttgttttccaattttgttcttctttttcatgatttttaaaaatatttagattcccctgcatttccataagagttttcagaacaggtcgacagtttctacaaaacaaacaaacaaacaaaaaaccaaaaaaaaccagctgctcttttgatagggactgtgttaaatctatagatcaatttgaaaagtagcaccatcttaacaatattaagtgttccaattgatgaaaatggagtatctttccatttatttagatctatatttcaaagttttttttatagttttcagtgtagaagtcatgtgctttttttgttaaatttattcccaattattttattttttttatggtattgaaatggattcttaaaaattatcttcagattgttcattgctagtaatagaaaaacaatttttttccactttgtttttttaatgtattatttatttatttttagatggagttttgttctgtcgcccaggctagagtacagtggcgccatcttggctcagtgaagcctccgcctcctggattcaaacaattctcctgcctcagcctctcaagtagctgggactacaggaacacgccaccatgtctggataattttttggtactttttagtagagatggggttttgctatgttggccaggctagtcttgaactcctgacctcaggtgatctgcccgcctcggcatcccaaactgctcggattacaagtgtgagtcactgtgcccaaccctctttggttttatagcctacaactttgttaaactcaattattggctccaaattttttgtggatttcttaggattgtctatatacaagttcgtctcatctgtgaataaagttttatttcttcatttacaatctggatgtcttttatttctcttttcttgactaattaccctggctagaacctccagtacaatattaaatagaagtgctagaggcagacattcttgtctgttcctgatcttaaggggaaagtatccagtctttcacaactaagtattatgttagaaatacttttttcatagatgtcctttattagggtgagggtatttccttctattcctagtttgatgagatttttaaaaatggggctgggcgcggtggctcatgcctgtaatcccagcactttgggaggctgaggcaggcggatcacctgaggtcaggagtttgagaccagcctggccaacatggtgaaaccccgtctctactaaaaatacaaaaattaactgggcaccgtggcaggtgcctgtaatcccaactacctgggaggttgaggcaggagaactgcttgaactcgggaggcagtggtggcagtgagctgagattgcaccactgctctccagcctgggtgacagagtgagactccgtctcaaaaaaaaaaaaatcataaaaatggtgataaattttgttgaaagtgttttctgtgtctattgagatgttcatgtgatttgtcatttgttttattactggggtatattatattgagagttgatttgctggattccttagctgcttttagtcattctaaagggcaaaaaagaaatgcaaaaaagtggctttggttttgtttttttgcctccaggtagaaggaaaaacagcccaaacatttccaaaggtaagttttgggtgggtcaaaaatgttaaaagcttacattgctctatccttcaagttgcgggacaaaaagttaaatccgttcccttggctagagcaaagctttagctaagccagagagaaaaagaaaaggggggagggaaaccagtgagataccagagcagcttcttcctcgactcccccaaatacacacatcttgaatcccagtagtgatctccaagcaaccataatgttaacaatgtacatgctgagtttactgctaggggtctgcagtgagaaaaaaaaggagagaattgtaaaaattcacattgtatttttgtgactattgcatttaaacgtgtctcaatcagtttacattgctatgacaaaataccattgattgagatttaacaacaaacattaatgtctcacagtttcagaggctgggaggttccagatcaaggtgctggaagattctgtgtctagtgtggtgggctcacttcctggtttgcagacagctacttttgtgctgtatcttcacacggcaagaggagagagcaagctctggtctcttcttttctaattagggcactaatctcatcacagggaggggggtccatccttatgatctcatgtaaacctaagcacgtcccaaaggccccagttccaaataccatcacactgggaattagggattcaaaaccagactttcggggggtggagagacataaatattcagttcatagaaagatgtatgataaaattcttataatttcacaaattctagagacatcacctcaatataagaaagtgttaatgggacataatttgctttctttttgccccagtgagaatattataacttaaatgcttagggtattgcaaacagaataaatctctctaactgatgctatttgctatgatttttgtctattggatcctctgggaaagggcaaacaacaggaaataagagacaatttttagatggagatttacttttggagttttaaaaagaaatttttatgttgcaaatggactgtcagagtctgacacttaaaggctaatgatttcccactgcctatctttgagtgagtcaaatagatgctaagggcttatggaatccttgcttgtcccttggactgggaacatggctatctgtctttgcaacattttgactttgctgctgttgaagaaaaaccactggctgtttttggaattcttaattcacagatcttaattacctgaacctgactctaagctgatagtgccttctatgggcagtttcagcctgagcagagctgtgcataactgaaagcaggcataggctcaattagcagaactctgattctgggactctgttgcatgttttaaacacccttctgtgggatcctagtctataaaaacgtcattgatgctggatggactatctggatcacttgcagatgcccatgaggaagggcttgttctctgatgaaaccatctaagattgagttgctgattgacttatatttctgatgcagaggctaattgtgttcctaacctgtgattccttccccaaattataagttagggatggacatattacaaggaatatgaatcttctgtccactcatgacagattggacacttgacacattcttaggggtgtctcactgatgttgatttgttttactttcttgagtaattacagtttgcaacaataaactgatggcctaactacttcccttactgttctcctggtgcacacatctcagtaaggcagtttatttaatgcagctctcctcagaaagagattttgcttttctaggctgcccacttggataagtggtcaggacaaaaggggtgtgaggttatgtaaaactatcttgaaaagtgttgaaactcaaaattctatcatgacatgtatctttctggttatgttgtataatttttgtcctgtgaaaatgcttttgtccctcctacatacaacctgcccagatgaaaatgacacagaatttttcttgatcacttttgccagccagagatacccagctggcaacacccttgccctgcctcgacccacagctttggggctggctcggccctgccactgtttctgtcacatggggcagctgccctctgctggtggaggacagagggccacaatgttacagccttctctgtacccatgtttggtgggtcctgagctcttgtcttgtgtccaagaagaatgaggatacactgacaatcaaagaatgaggagggcagagaataattttactgagtgaggaaatagctcacagtggagaggggacataagggtggtccgccacctggagtcaggtggtttctctctcactgtggctgagtccagagctttcaaggcttagaataagggagtgagtactgattgatttgtgagaatgcaaaaaaagttaaaggtaccactcaaaggtgggcataacagtgtaaaaaatcaattagggaagcataggtatatgtaaaataggagaagggttggggagatcaatcagaggaatgtacaccaaacaggaagacaggttctcagtgaatttgacttgtagcttggctttcaggctttaaactgtctttggcttggaggtggggtttcaccagggaccccaccctgtctgcctaggcatttgtctgcttcttgcctctatcaaaaaggtctgagtgagaattaaaaatatgattggggaaaatgtaaagttttgataattgaatggaacacactcattttgtaaaagtgggagaaaaatcaaaaccctgccacctgtggaggcatgaggaggagtggggaggggagatattaatgatctctgtttttcagaaccattccttgaagctttccctttgtcttgaaggaaaactcctcatgctgtctttccaaacagctgcaagtgctttgtatgcaaacttcagagcctatgatcatatctgttggtatgctgactcagacagcaatgggtggccccagatcctgtaccttctgtatagaatacctccaaatgctgtccacgcttataaagctgataaactgatgttatgtgcaagcaaacccgtttggaacagattactttagtcattttctctgaaatcaagactaattctaatttttcagactggactgggaaacttagggcaggaattcccattatggaggccacgttggggtcctgataagctgtactgcctaatgtatgtcctacttggggtaccctaataattataaattctttgtttctaggggtactacatgagccttctgggactatacttcttgtgtgtactcatactatcatgacactgcctgagtcccaaaaggatttcaggtcagcttaaactaagtggccagagttgtgctgtgcctgaattagtgtttttaaagtacggaaacaagtaaaaagtcacatggctttctaagatagacctttgtggtgaatgggattttttttctaactggttaaatccagtacccctaaagggcataatcaagatcaataccacaggttggcctcaccctgctacatgaggtcttacagatataataatgttgctatctaaaggcttgtcaattttcttaaattttatcaaagagcaaacttttggtttcatttttttctctgttgtttttctgttatctctttcatttgtttccattctaatctttattatttccttccatccgcttgctttgggtttatggctcctctttatttaatttcttaaagatggtatggtatgctattggtttgagatttttctttttctcttctttcctttttttgagatgtgggtctctctctgttgctcaggctggagtgcagtggtgtgatcacaactcactgtagcctgagtgtcctgggttcaagggatcctcctacctcagcctcttgagtagctaggactataagtgtgtgccactatgcctggctaattttttaattttgtgtagagacatggggtcttgctatgttgctcaagctggtctggaacccctgggctcaagcgatcctcccacctcagctttcaaattactgggattataggcatgagccattgtgcccagcctcttctgtttaaatataggcattcagagtgataaattcatctctaaactatggtttagctgcatcccgttcattttgaaacattgtgttttcattttcatttatctcaaagtagttttaaatttcccttgtgatttcttcttgatccattagttttttaggactgggttgtttaatttttacatatttgccaatgtctctaaatttccttctgttcttgatatctgatttcattccattgtggttagagacattttttagtatgatttcctgcattactgcttttttgtattaaatagatattttctactgtaccattttaatttccttgtcatttcctgtgttacatttttgagttattttgttaacacttgctctggaatttacaattagcatcttaaacaaactaatttggttaatgctaacttaagttcaaaggtatacaaaaactttggttcagtatagctctattttctatttttgtgctacttttgtcatacaaaagacatttttatacattataaagacatgaatagttttagaattattactttacatatgcaattgtctctttaatcagataggagaagaatagggttacaaacggaaatacactcatactgtgttttatatttacctacctttaccggtgcttgtcatttcttcttgtcaatttgagttactatttagtgttttccattttagcccagaaagattatttttagtacttcttatacagcaggtcttctagtaaataattttttcagcttttgtttatcttagtttctccattatttttatttttactatgattttaataacaaaactttagttttatatggtattagatttacagaaaagttgtgaagatagtacaaaaagggttcccatataccccactttcagttttccctactattaatatcttacattactatggtacatttaaaagtaattaacccttattgatacattattatttactaccatccatactttattcagattttcttagttttgactgaatgcttttttttctgttccaggatcccatccaagacaacacagtgcctttagtcatcatgtctcctggggctccttttggctgtgacaggttctcagactttccttgtttctgatgatgctgacaattttgaggtgcacttgttaggaattttggagaatgtttctcaattgggatttgtgtgatatacttcttatgattacactagggttatgggtttcaggggggaagataacaaaggtaaagtgcagttctcatatatcaagcatacatgctatcaatgtgacttattactgtggtctcctaattacttgatcacctggctgagatagcatttgacacctttctccatgcaaaattactcttcctgccccattttcattctgtactctttggaaagaattctccattttcttgagagggtaataacaacataaattatttagagttcttctccacaggaaatttgtctattgtcctccatttatatatttatatatgtaagtgtgggctaataggtatttattttctacttgttatatactatgttatttatgttgttgcccaaattgcttcagttttggatattgggaactttttcagttggctcctgtgtccctttgacattcatccacagatatgtgggtttttaaaaattttgagcatttccttgctttttggctttataagatgcttatcttgtatatattctgaccaagacctagaatcagccatttgtctaaggatccctgattgaatatttttattggaaaatgttactaacagccaagatcttggcactgggtgtgctcagtgttactggattttatcgcttctatctctttatctgctcattcttgtgccttatactttctatgctattcacttccagtttatcagctacttggcactttaatttattccttattttttttctgtagaatcagcctcctactctaatgtgaatcctcattggcttacattttgaatctcatcctaaaaaaatataaactttcataccaacttgcctcccccttctccattatcctcttcaaaaccaagtttcttagagatttcaacttacactgcctctaatttttttgcctcccactcaaaatctcacagtcaactttcttctctcattccattgactctgctctgacagggccaaaaaatgacctccttgtttctaaatctaatgagtgcttttatctcctcatctgcctggactaatcaatactatttgatcttgttaactatgcaagaaattctcttcttgaaactctcctcattcctctcttcttttatgacactactttcctgattattatgtccctaggataatttttctcttttgcaggctcctctttctctgccccctagttaatatttcctaggctgactttttgtgtttctttctctttctgatagattggttaaaaaatgtttgcatagatctcctgcatatgtgttaagaaatttcttctgacttacaacatatacaacgagagtctttaatcaggcttctgctataaaaattaattttcctggattctgtggattggtgttttcatcagttctggaaaattctcagtaataacctgttcaaatacagtagtccccccattatgtgcagtttttccatggtttcagtcacctggggtcaaccatgatccaaaaatattaaatgaaaaattccagaaataaacaattcataagttttaaattacatgctctttcaagtagcataataaaatttaatgtcatcccattccatcctacttaggaagggaacatcactttgtccagtgtatccacattgtacatgctacacattcattactcacttaatagccatcttggttatcagattgactggcatgatacagtgtttgtgttcaagtaacacttattttacttagtagtggccccaaagtacaagagtagtgatgctggcatattgttatagttgttgtattttattagtagttgttgttaatctcttactgtgcctaatttataaattaaactttgtcataagtgtgtatatataaatacatatatatgtatacatgtgtgaatatacatatatatttgtatatacatttatatattatatataaatatattatatataagtgtatatatgtatcatatataagtaatagatatataatataaataatatacatttatatataaatataaatgtatatttatatatgtacatataatatatattatacatatatgtataatatatattattaatgtattttagttaataatacaaataaatatatattgctatttatatagaatataataaagcataataaataataccctatataaagacaaatatatgcatttatatgcatattttgtatgtgttatttatacatatataaatacatatatatttgtgtatataggactcagtactatccagtttcaggcatccactggcagtctcagaacatataccccatgtacagcctctgattctttccttttttattctctttctgaaactttgattaaatatattttagtctttttattggactctttgtctttttgtatctattacatatttcccatcttttctttctctattctgcattctaaatagtatctttgacttatctcctaattcgctaattctttcttcagctgggtctagtatcctgtgactgttttaactcatagttactgtgattttcatttctataaatcctattttgttatttttcaaatttattacctcaattttttatggtttcctcttctgggcagaaatctttaagcttaaacatttcttttcaaaaaatttagcatgtgtttcacatctgtaagttctcattactccaatttctaaagcagtctttgtgtatctgggcttttctgtctgtagtttttgctggttctttattgtggtatcttgtttcctagttcttggttatctatgcttacagccaatcactgtgttaaatattatttgtaggcataatttaaatcctagaatgaaaatatcttccttcaaaaaggatccacatgtgcttctattagggggatagtcccagttcaggaccacgttaataaggttaaagctttgatttttcccagatggcccagtcaagtcaaactggatgtgactccaaatgatgtttgacccacttccacttcacattcacccagatactgtagccttttgaagtcctggattattgtgcaaaagctctactgttagattttctatctcatgtaagctctgtgttttgatttactttacctgaaacttctaaataaaacagttttcataatcatttacctctctgaattcttagtttcccttcaatttttaccgttaattttctttctgtattgtcagttatttattgtgttaataaaacttaaaaaaaataaaccccattcatttttacagttgtttttaatgggaaattttgtccaaattttccagttatgatcatcataaccagaaacaaaattgtggctttccagtgtaggagactgccatcctagattatgtaggacttctttctttgtaaatctccatttattaaatatattttatatattagaatggcaataaggtatatcggtcagggttcttgatggcaagcaacaaaagtcaactctggctattttgaatagaaaaaaagttatgaaaacatactgaaccttatggaatctcaaagaagcctagagaaacagacttggagaaagtggctgaacaaaatagattcacaaagcaaagtcaaaagccattccacagaactaattttgtgcatatactgctgccatcttcactgctacagtgattgtcagtgtttcactgccaatacttttggccccagtactgatattgttgaaattgaatgttcctgccatttgtcctactggctcatgaaataaaatattattctctcttctttctctttgtgtcactgatttctgattcagggtctagaatgggtgcatctgattgacccagtctggatcatgtgcccacaccctcagagggaagatgggaaagtaaatgtctcataattgtaacttccatgataggaggcaaatcttgctttctatctagattcaaaaggtagaaaattcgcagacatggtaaatgggcctattacagaaatacttttttattataacaatattttggtaaaattgtacaatacatggtgttttgctggtccagcccttccacagtatggaaagattgaaggaaccagtaaataacatcccaaaggcaatagaactgggatcaactttagacattggcatcttctagtctaggcctagccattacctccattgtcttgactgtcccacttgcttattgcaccttcagcaatctctagataaatagcaaatgtcaccagaaagactgaggccaatagttacagtaaagggcatagaaaaatctaaaggtacatagtcaagcatacaggtatgattcctctgcttctccaacaatttgacatatgatagtctctgctatacccaagaggccgctttgctaggcttttggctcagataggctgctttcattagtacgtttcacctgccttatatttctgcttcttaattcccaccttgtcatcatatatggacattctgctttgttagttgttcacttaatgccacctcctcagctagaattacattgctggaaattcactgaagtaaaatatagatttctcagggcaatagtaggcagtttaaagttctatatctctcacagagctctgtggatgacatatatgaagcaaccaggaaggtcttgaataagaagacccttgcgtagcacagtggttttaaataacatctgtgtaactccacattttacatccgtagctctgatcttccactgaactttagacatagacatgtgagtggaaatatcaagtaagcaatcggatatataataaacatcaaatatgcaacatggccaaagtagacctgtttttctccaagtgttccctctcacaatgaaggatgccaggttaaacaccccaaacactgctgttctcattaaggttcaataggttttcttgaatgaatgcttttcaaattgttccaaaccttttattaactataagactttggaaaaggttgattttcataaattggtaatattttcattgctttgctagaagagcagatttatggaggttccgttatggaagttctgccattgtctatgttgtttggctgtacctagtacaagaaatatgaagaaatgaatctattaaatcattgcgtgcattaaaaagcttgttaaagttatattatcattttaatgttgagatttcattttctaaaagctcatttagaaaaattttacattcataaataatatattttctgaagttttcttttcttgtaatcaatttgattttgggacttgagtcatgctggcttcataaaattagttgggaagtgttcccttctctgttatctgaatgatgctatgtagaattggtgttacttttctctataaatttattgaatttgcctgaatttttgttttcagatttttaactaagtattcaatttttaaaatagtcacagactatttcagctacctatttattcttgagggagtttatatagtttgtgtttttgttttagaaattggcccattacatctaagttgtcactttacatgtgtatatttgtgcatactcttccattattatccttttaaactaaaaataaaactaccatacaatccaacaatcccactatgggttatttatccaaagaaaaggaaatcagtgttatcagagggatacctgcacccgcatatttattgcagcactatttataataggcaagatatgaaatcaacttaagtgtccatcaatggatgaatggataaagaaaacgaggtatatattctcaatggaatagtgttcagccataaaaaggaacaaaattttgtaatttgcagaatcacggatggaactggaggtcattatgttaagctaaataagccaggcacagaaagataaatactgcatcttctcactcttatgtgggggctaaaaagttaatctcatggaggtagagaatgcaatgatagttaccagaggctgggaagagtgtgtggtggggtggggcatgaagaaaggttggttaatggatacaaacatacaggtaggtaaaaggaatatgtccttatgttcgatagcagagtagagtgactatagttaacaacaatgtattgtatatttcaaaacagctagaagagagaacttgaaatgttgccaacacatagaaatgataagtgcttgagatgataggtatcctaaatatcctgatttgatcattatacattctatgcatgtaacaaaatgtcacatgtaccccataaatatgtaaaaatattacataacaataaaacaattaaatctgtatgacctaaagtaatattctctcattcttgatgatgataatttgtgttctctttattttattcttgctacaggcttgatgattttattaatcttttcagaaagactgcttttggtttaattgattctttgttacttttcttttcatattttattgatttctgctcttacagttattatttttaaactctgctttaattttgcttcttgttttctgctcatgtaagggggaagctttagattacaattttcagattttcctttttttctaacatagacatttaatgctgtagctttccatctaagtaatactctagctgcatggtgcacattttatatgttgtaattttatttttgttcaatgctaaatattttctgattttgattgagactttctttttgtcccatataagtatgtcatttaatttccacatgtttggaaattttcctgttatcattttgtcattgattttaaatttaattatgttaaatttatatctgagaacatgcttcatatatttcaattgtgttacgtgtgctaaattttgtctcattacctaaaatatggtctgttttgatgagtattgcatggacacttgaatttatattctattgttgagtgaaaaattctatgaatgttgattagatccagtttgaaacatcattcatttattctacatcattgctgattttctgtctgtctatcactaagaaaagcatgttgaaatttccaggtataattgtgaattgatttgcctatttctccttttaattctgctagttcttgctttatttgaaattgtgttattactggcatacacatttaatttactgtgtagattgatttgtctgattctgcttttagttctgttcttgctttatttgaaattctgtcattaatggcatacacattttatttaccatgccttcttaatgaaaaaccattttattattgcataatgttcctctttactcttgtaaaatagtatttgttttgcagtctacatctactttgtcagatattactacagtcactccagctttcttgatttttgttttcatggtgtatctttttccatccttttatacttaacctatctataattgaagtgaatttcttgtatataatgtatacttcagtcatttaaagaaatctaatctgacaatctttgtcttttaaggaaagggtgactgaaaacccagtaggagagctttgtggcattttcacttacccttgcctgatccccctttccctggctcagtggcagtctggaagatgtcagcccacattcctgtggtgggtttctggtgccagaggaagcagtatgaacttgttctaaagaagtatggttttctgttttgacctgttgggtgattctctgaaggagtaacacaaaggccttatctttacggaacctaaccaggaattctctcagggaagagaagcaactgtaaaagaagaatttgtttaaagcatttagaaataaatgaactggctgctgtgacctggggcaaaagatatcaattaggggcaaataataaacatattaagaatactgtgagaacaatctaggaaggaagatgtcttggagaataaaggctttgagaagcttccacatgttcctcagaatttaggaggtcatatacatgcctgtggcagactgctcagaaaaaaaaaaaggcactaagctttgagctctgtcttcaagctctacacaagcaggaagcgaaggtgcaagaatagttgtaaactgcctgggagaatgtggaaagcatgcctcagtgcgctcccgtgtgcgcgacacacacacacacacacacacacacacacacccaatctagcttcaagattggaaatttggtttttggcttcaggaatttaaagaaatctctatcaaatcactagctgatcactaagctaaaagaacagagaatttaggaaatcacacatgacaaagactagaatagtttaggaaactcatcaaacgaaaaaccagaacccacaaaatgcagcaaaactaaccctggtaagggaaggagaattggattttcatgtaataatatacaaaatacccattttttgattaaaaaaattatgaggtatgcaagaaagcaaggggggatgacccattcaccataaaaaaaataagtgaacagaaactgtccatgaggaaacacatacattgaatttactagacttatactttaaatcaactgtcttaattaagctcattgagttaaaggaaaacattggcaaagaactaaaggaaatctggagaacaaggtctcaccaattagagaatttttagtaaagggatagagattatacaaagaaactaaatagaaattctggaacaaaaagtataactgaaatgaaaaatttactacaggtgttcagtatgagatttgaatagtcaaatgagtcagtgaatatgaagatgagtcatttggaattttccagtatggcaagtggaaaaaaaatgaagaaatatgaatagttctaaagggaactgcaggataatgtaaagcataccaacatatatatgtttgaagacataatggccaaaagttttccaaacttgataaaggacatgaatctacacattcaagaagctccacaaacttcaagtaccataaatttaaagagaccatactaagatacgttgtagtaaaaatgttgaaagcaacagcaaagaatcctgaaaacatcaagagagaagtgactccttgcatacaagttatccttaataagattaactgccaatttttcttcaggaaccatggaggtcagaaagcagtggaatgatatgttaaagtggtaaaagataagtttgtcaaccaagagttctacatctagcaaaaatatccttcaaaaatgagggagaaattaggacattgcaagatttttataaaagtttgccacttgccctacaataaatcataatctaagtctgttaggctgaatggaaaggacattagacagtaactttaaaccgtaagaagaaataaagaaaaccagtaaaggtagctacatatgtattttgggttgctggtgtcctctcaaaagttatattgcagtcctaactcctaatatattagaatgtgaccttatttggaagtaacatcattgcagatgtgattagttaagaaaagattcttctggtgcagcgtgggcttttaatgcaatgagtggtgttcttataagaaaatgttgtgtgagcacacagggagagtgctatgtgaaggtgaaggcaggaaatggagtaatgcatctacaagacaaggaacactaaggattacaagctgtcaccagaagctagaagagagacatcagatagattctgtctcagagtcctcagaaaaaaccaacatggatgacacctagatttcagatttctagcctccaaaactttgaagaaaatgaacagagtataaatttctgttgttttaagccacccagtttatggtagtttgttatggccacacagtgtctggtaatttgtcatagtaacctatctatgtttaataggtagatataaaagccagtattattatattgcttgttttttaaaattttgtttttcttttttgagacggagtctcactctgtcacccagactggagtgcagtggtgtgatctccgctcaccgcagcctccagctaccaggctcaggcgattctcctgcctcagcctcctgagtagctgggattacaggcgcacaccactaccaccttgctaatttttgtatttttagtaaagatgggttttcaccatgttggccaggctggtcttgaactcctgacctcaaatgatccacctgccttggcctcccaaagcgctgggattacacgcgtgagccattgcacttggcttatattgttagtttgtaattcctcttttttctgtcttattacaaaagtaaatgtataaaacaataactataaatatatgttgataagaacgcaatatataaagatgcaatttgtgataataacaacataaaggggtatagatggagccttatagaaacagatcttgtgtaataggaaagctaagttggtattaatacaaactaaatggttacacatttaagatgttaactataatccccagggtatctaagaaaataactttagaatgtagagaaaaggaaatgagaagaaaattgtcactctataaaaaaatcaaacacaaaagatggtagtaatggagaaaatgaagggcaaaaagtataagatatgcagaaaacaaatagcaaaataatagatataagtacttataagtaattactttaaatgtaaatgcattattctcctcaattaaaggcagagatagacagaatggataaatgaaacaaacatgatccaactgtgtattgtctataaaatgtatactttaaatataaaggaaaaaatagtttgaagtaaaaggattgaaatagctattccatgcaaatagtaaccaaaagagggctgggatggctatagtattatatcagataaaatagactttaagtaaaaattgttaaaaagacataaaaggatagtatatatttttaaacaggtcaattcttcaagaagatgtgcaatttgtatacttgtctaagaatagacagttctacaataatagttggagacttcaataccacactttcaattaaggatagagcaactggacaaaagtcaataaggaacagagattttgaataacactatataccgactagatctaacagactataccaaacaacagctgaatacttaagtgcacatgaaatattctccaggatagataatattttagaacacaaaattagtttcaatacatttaaaattattgaaatcatgcaaaatatgttttctaaccacaacgaaataaaaatagaaatcattaacagaagaaaaatggaaaaatcacaaatacgttgaaattagcatgtgtctgaacaactaatgggtcaaagaagtaatcacaagaggaattagagaattaaacataaatgaaaatgaaaagacaacataccaaaactcatgggatcctgcaaaagctgatgttttaatttaggttctttaagatggaaagaatcccttcaatgattaggagagacataagatgaaaataaagattttaagagagagaccatgagtggtgggccaatacctttattggtccagggcattatccaaacaggtttccctcagggagttttaactggtgggtttaaagcaatcaggcatgaattccaataggtaacgctgtgtctgagaggtggtcactgtggcatatctgcacagtgcatgcagggtgtgggggtcagcagagccagtcaagaggttgtatctagctatcttatagagaagtgatcaccaagaggaagttgtctaagacacatatctggatcaaccacattatgaaactgggggtggggagggtgtagaactggaaactgtggccaggcgcggtggctcatgcctgtaatcccagcactttgggaggccgaggtggacagatcacgaggtcaggagttcgagaccagcctggccaatatgatgaaaccccgtctctactaaaaatacacaaaaattagccggatgtggtggcacatgcctgtagtcccagctactccggaggctgaggcagaagattcacttgaacctgggaggcagaggatgcagtgagccgagatcgcaccaccgcactccagcctgagtgacagagtgagactccatctcaaaaaaaaaaaaaaaaacccactggaaactgtgtaaagggtgactgagccctgattctggtaaggaaaattaaacttatatttaaaataaatgcccagacgacttaaaatgataagaattcactgaagcagttctcaatagaaaatgtctagctgtaccaacagacatatgaaaaaatgctcatcttcactggtcatcagagaaatgcaaatcaaaactacaatgagataccatctcaagccagttagaatggcgatcattaaaaagtcaggaaacaacagatgctggagagaatgtggaaaaataggaacacttttacattgttagtgggagtgtaaattagttcaaccattgtggaagacagtgtggcaattcctcaaggatctagaactagaaataccatttgacccagcgatcccattactgggtatatacccaaaggattataaatcatgctgctataaagacacatgcacatgtatgtttattgtggcactattcacaatagcaaagatttggaaccaacccaaatgtccatcaatgatagactggattaagaaaatgtggcacatatacaccatggaatactatgcagccataaaaaaggatgagttcatgtcctttgcagggacatggatgaagctggaaaccatcattctcagcaaactatgacaaggacagaaaaccaaacaccgcatgttctcactcataagtgggagttgaacaacgagaacacatggacacagggtggggaacatcacccatcggggcctgttggtgggtgggagattgggggagggatagcattaggagaaatacctaatgtaaatgatgagttgatggatgcagcaaaccaacatggcacatgtatacctatgtaacaaacctgcatgttctgcctatgtaccctagaacttagagtataataaaaaaaaaaaaagaaaaagaaaaataaggtcacgtgcactggcctagataaaaaaaaagtctagctgtaaacaccctcattccaacagaaaaattatctcaagtcaataagctaactttagattttgaggagctaggaaaaaaaaggaaactgaggccacagctaacaatagaagaagagatggttgaaatacagaacataaaaatacaggaaatcaatgaattcaaaagttggttctttgaaaaaatcaacaaaatttacaactaataatagctaaactgaccaacagaagacacaaagaagtagaatcagaaatgaaagtggggtattacaactgaatcaacaggaattaaaaagattataagagaatactatgaagaaatgcatgctgatgtgacaatgcagatgaaatgaacgtattcctagaaacaaactaccaaaactgacccaagaaacagaaaatctgaacagacctataccaagtgaacaaattgaatcaccaatcaagaagtaaaagcccagaagcaaatggcttcactggtgagttctactgaacatttaaagaagaattaacaccaatccttctctaactcttccaacatatagaggagaaaaccatttctaattcactatgtgaggccagcatttgcctgaaaccaaaacaagacaaagacattgtaagaaaaaaaaagtgctggtcaatatcccaaatcaatacagatgcaaaactcctcaacaaaatactagcaaaccaaatccaacagcatatttaaaggattattaccacgaccaagttggatgcatcccacaaatgcaggggtggttcaatatacaaaaatcaatgtaaccacattaatagaatgatgggggaaaagcacattatttcgattgatggaaaaaatgtatttgacaaaatcctgcactgtttcatggtaaaaaacaaaacactcaaaaaacatggagggcaatttcctcaacatagagcatttatgaaaaacccacagctaacatcaaactcaatagtgaaagtatgaaagcttttcctttaatgttagagataagacaagcatgcctgcatttgccacttctattcaatgtcatactggaagttctagccagggcaattaggcaacacagagaaataaaaggcatccaaattggatagaaaaagtttaaactatctctattcacagatgacatgatcttatatatagaaaattgtgatgaatcctcaaaatacgattagagctaataaaaatacagcaaagttgcagtataataaatcacactacaatcagtatttctatactcaagcaatgaacaatacaaataggaaattaagaaaataattccatttgaagtggcatgataaaaaatacttaagaataggttttaaaaatgtacaaggcttgtacatagaaaactacaaacattgatgaaaatttaaagacatacaaaaatggaaactaatcctgtgttaatgggtttgaaggcttaatattgttaagatggcaatactccccaaagtgatgtacagatgcaaggcaatcctatcaaaatctctatgacctcttttgcagcaatggaaaatctcatcttaaaattcatgtgtaattgcaaaggaccctaaatagtcaaagcaatcttggaaaaaaaaaaaaaacaaagtaggaggacccacagttcccaatttctaaacttactgcagactatagtaatcaaaacagtgtgatactagcataagaataaacatgtagatcaatggaatagaattgagagttcaaaaattaaaccaatacacctatatcaattcattttttgaaaaggatgccattatcattaaattgagaaagaatgttttaatgtatgatatatactgtatgtatatactaataggatacacactactctgaatctccggagaattctaagacatataaatgtccaacgagcctatcaaaagatactcaacatcattaatcattatggaaatgcaaatcaaaaccacagtgagataccactttatactctctgggatgggtataatacaaagagggaaatgttaagttttggcaaggatgtggggtaaattggaacctttataccactgctggtgagaatataaaatggttcaactgctatgagaaacagtgtagagttttctcaataagtacaacataaaattaccacataatccacaaattccaatcctggtgttacacccataatacttgaaaataagtattcaaaggaaacatgtacacagatgttcatggtagttctatgcgcaataagcaaaaggtggaaacaacacaaatggccatgaactgatatgtggatgaacaaaatatggcatatcctacaatgggatattcaaccataaacgtgaagtatagatgcatttacaacacggataaaccttgaaaacatgctaattgaaagaagctgtacacaaaatggacacatagtgtacaattccatttgtatgaaatatccagaataggagtatatagtaggaaaaacacaaactatctgttctactattctcacaatactcacaatagttttgacaccacgtgtatgtttcccatactaagcaattctccagtggacaccaactgagtgactacaattcaattctgacatcatctacctggagtcatattccatcgcttaagagctcattcccacaaaactgtcttcactttagaggccaattgcaattctgggcttctggaactgctaacatactggctgtaaataggggattcctacaattcccccctcaggttcaatcatttgctatagtggctcacagaactcgggaaacacttaatactgctgatttattacaaagggtattttaaaggatacaaatgaatagctagatgaagagatacatagcgcaaggttcagatgagtcctgagcacaggatcttctgtcttcatgccaccctcctggtatgtggatgtgtttaggaccccaaaagctccctgaacccagtccttttgtgtttttatgggggcctcattacataggcatggttgattaaatcattggtcattggtgatcaattcaaacttcacccttcctatcttcctggagatcactttggagattccaaggattttaggaccagtgagccaggaaatgggaatgaagacctaatataaatttattataagttataatattacaatgagaaatccatagagatataaagcatattagtggttgccaggtactggactggggcaaaaagagaaagggaaatgactttaatgggtatggggtttccttttggggtaatgaaaatgctctggaatgagagtagtgatggctgcacaacattttgaatttgcaaaataccactgaattgtacattttaaaatggtaaattttctgttatgtgtagcttatcacaataagaaaaacggagggtggttttggcctgtagtcccaagcttggtgacccttgctctaggtatttaaaaatgtatatttgactttcacaatctacctagatgcaatgttttactattctatttggaatgttgaagctgtcattttataggttcctttaccctgctgtctttatgctaattgtcatatatatacatatactgaaaactcatcagacatttttatgttcgttgctgttaaatacaattttttaaaatgcaagaaaagtggcctatcatgtttacccaattgattgctgtttcttttattcttccttcatccccaatgttccacatttccttcaaggtaacattttcttcctgtctgaaaaggctttttcacaattctcttaatgcatatctgctggctataaattctcttagatttattttatctgggaacatctttatttcacatctttccccctgaacattatttcactggatataaatttggaattgatagatcttttcttctttcatttgaaaaatgttgtgccacttctttctggctcctgtggtttctgatgacaagtccaaagtcatctgaatcctttcttccccatatgcaatggaccatttttctctggctattttcaagatttttcgtgtgtgtctttagtttttggcaatttgattaggatatttcttggcatgaatttctcttggtttatctgtttgagatttgctcaggttcttgagtgggcaggtttatacctttgccaaacttgggaaaatttattccattatttattcaaaaattttttttcagcagcactgtctttcttctctctttgtaaggctctgagaatgcaaatgtttaaaaagtgggcaaaggacatgaacatatgcttttcaaaagaagacctacatgcagccaatgagcatatgaaaagaatgctcaacgttgctaatcattagggaaatgcaaatgaaaaccagaatgagatacagtctcacaccagtcagaatggctactattaaaaagtcaggaaataacagatgccggcaaggttgcggagaaaagggaacacttataccttgctggtggaaattgtaaattagctcagccattgtggaaagcagtttagtaatttctcaaagaattcaaagcagaattaccattctacccagcaactccattattgggttcatacccaaaggagtataaatcattctaccacaaagccacatgcatgtgcacgttccttacagcactactcacaatagcaaagacgtagagtcaacctaaacgcccgccaatggtagactaataatgacaatctgatacatatacaccatggaatgctatacagtcatcacaaagaacaagattatgtgcttggaagcaacatggctagagctggaagccatcgtcctaagcaaactaacacaggcaaagaaaatcaaatacctcatgttctcacttataagtgggagctaaaaattgagtacatatggacacaaagaaaggagcaacagacactggggcctacttgagggtgaagggtggaagtggggtgaggatggaaaaactacttatcgggtactatgcttattacccgggtaatgaaataaactgtacaccaaacccccgtgacacacaatttacctatacaacaaacctgcacatgtacccttaaaccgaaaataaacgtcaaaaaaaccccagcaaatatatattggtaaaacaatctttgtaaacttgtaagtttatatttccttattcttttgtaagtagtgaaaggcgaactgttttttcctctggaaacaaaaaagatgttggccagggcccagttttcctttggaggcctgactggtgttaggtctgtttctgagtttactctggttgttaggatctacttccttgtgtctcttaggctgaggatcatgattcttattgattaccagttagaggacatgctgagctcctacaagctgctctggaattccttaccacatagccctctccataagctgcctcacaacatggaaacttgcttcttcaaagccagcaagagagaaagacagcaagtctagcaagatggggtctttcatcacaggagtagcatcccatcacctctttcatataacgtagcataaccatgggagtgacattccattatctttgctatattctattaattagaagcaaagtcacagatctttctcacattcaaggggagtatgttatacaaatgcatacataacaggaggtggggatcatggagtccaccttaaagtctgtttgccacaccaacactgtatttttacatttgttgcaagaataagatctcttttatgagcacttttataatagctgtatttgtcagataattcaaacatttgtgtcatttctgttttcatgtttgtttgtttcccactacacttggaattttcgaggtttttaatatgtctagtaactttggatttatcttgtcattttgaaaattatgaaactctgggtctctcctaaactctatggagaatgttgatgttttgctatagtaggtagtcaacctgattaacttctggccccaggcaccaatttgccttctgttgctcatggttcctattgcagttaagctttcatagactttgcagtactattcaaatctgtcttgtggagtgcaccactcccagtagccagtctgagtcttagggagtggtctatcagttacttcagttctcaaaatatttggtaggctaattaagatcagattcatgcatgcacagctcacatgttagccctggaactcatatgaaaaaaaacttcatagggtgttttcccaagctactgcctctctgcaacctttctggtgctttttgcttccttgagtctcctttatttggcccttcagccagaaatgtagttctcttataaccttggtttatcattctctgtcattcacttttgtgattgggctcatttcctggcccaagaaaggaagggcagagagaggaaaaggttaacatatgtttacccccaccctcttaggaccacagctccatcaaatggacaggattggctcccttccctccgaggtttggttcttgaggttttgtcatttatactacaagatttcctggggtctgaggcatgagagaacaaaaaagaaagagggggaaaaatgggagttctgcactctctctgagcattaggagctaccatttttggccctcgagacagtactagagggcttctcctggagctgtctgtctatactggtgcccacttctgcattttggtctgtgctgagttcaggataggcaatattaaagggaaaaggggtaaaataaaaagtaaactcactgctgatacactggtaattctactactggtgttctttccttctctgtcttgctactgtttacctttcagacgcctcaaatagctgcccatgtattctgtcctggtttgatagttgtgttcggggggcagacagggtgaagcaagctcactctatcttactcaggaccagaactcctgcagtagattctttactgcccacgttgcttcttctgtgtagcccttcttacaaaccattctctacatagcaactggagtggtcataaaaaccctcaataagattatatcactcccttacttaaaccctctgagtgggggccaggcagggtggctcacacctgtaatcccagcactttgggaggccgaggtgggcggatcacgaggccatgagatcgagaccatcctggttaacatggtgaaaccccgtctctactaaaatacaaaaagttggccgggcatggtggcgggcacctgcagtcccaactactcgggaggctaaggcaggagaatggcgtgaacccgggaggcagagcttgcagtgagcggagatcacgccactgcactccagcctgggtgacagagcgagactgctgtctcaaaaaaacaaaaaaacaaacaaacaaacaaacaaaaaactctgagtgggtttctcattttacttaaaacaaaaccaactcctcatgatggcctacaaaatcctacatgatctgagccgtgcctctctctccaaactaatatcacatccttatccctcacttgtatcatcagccccatgcatcgtctttcagttcttagggtaaggcaaatgcaattactcctttgagatttgcatttgctgtgctgtctttctgggatgctcttctctaagatctttgcatgactgcccacttttttttttaatttaggtctcagctcaaatgccacttcctcagatagtccttttcagacaacttaatctaaagtaacttaaccctttccatcgctttgttctattaccttcagagaacttaccacttcctattatgtaatccctatatttgttcacttgtttgttttccttttaccactgaaatttcagctctctgagggcagggatcttgtctttcttgttcaccactatatcctcaatgtgactagaatagtattttacacatagtacatgataaaaaataattgttcaatgaatatatttccaatcttattttcatgtgtgtattttaaaaccataaaacatttttgtaaaagctatgtttaatagggttttatattctgtttcattaaatatacttcaacaacatcacctcaagagttgcttcattgcactgggtgcttttgtgtgaagtagtctaacagtttgcatctctggtatctgatttgctttgggctgaaattgtaattttgtctttgttcaccttgtcattttctcatccttttatttcttttaagattttagacattggattttcataaagcacttcttcactgcaactattttatttattgtattacttgactatttcccccttaagaatagaagttccagagtagctgttttgtccactgctgtatcctcaatttccagaacaggcactctataaatgtttgttgagtgaacacatcatatttaatttatttaattgcctcatttgtaaaatggagatggtgatacttatgtcaatgaatgctgggaagagcagtagagctatatcatggtgtggatactaaagggcaaattagatgccttgactagctgcgagtctgagtcctgcacaccagcttccacaatgatgctaaatcaaatctgtgtttcagaaaaattgcaaactaccacctgaagtagaacactgacattgcacttatatagttcaaactgcaaattgttaaaagtgccaaatttcaactccatggaaaggtaatgaatcccctaaaggaattttttagatgggaaataggagtgaaatagatcatgaaacatctcattacaaaagttgaggaattggagaacttgacttgatttgacaggcaaaggaacaatttgaaatttctgaacaggtaggcagtgtgataaaaatgaggtttgcatgtgagtctatttttcactgcaaagagagacccccaactgttcaatgctattatttttggtggtgcttttggtctggtaaatgagaagggctgtgttatggattggatatgtgtgtcccactcaaattcataaatcgaagctctaacccctagtgtgattatatttggagattaggtctttgagaagtgattagttttagattaggtcatgaaggtgaggtcttcatgatgagattagtgtccttaaagaagagagaatggctgggcatagttgcatatgtgcatatgcatatgcatattatgtgcatagctcatgcacataatcctagcactttaggaggctgaggggggaggatcacttgagcccaggagttttagaccagtctggcaacatagccagaccctgtctttacaaaaaatagaaaaaaattagccaggtattgtggtgcatgcctgtggtcccagctacttggtaggctgaagaagaggatcgcttgagcccaggagtttgaggctgcagtgagccatgattgtgccattgcactccagcctggacaacagagcaagaccctgtcttaaatatatatatatatatatatatatatatatatatatatatatatatatgagagaaagcgggagagctcccttgtatgagcacagaggacaggccatctgcaagtcaggaatagagtcctcaccgggaactcaatcatcctggcaccctgatctcaaacttacagactctagaactgtgagaaaatagatttctgttgtttaagccatctagtctatggtattttgttatggcagtgagatctgactaagactggtagctggcttctttgtaggatcttcagtattggcaaaggcttcccagaagctgtgtttgactggggcagtggaaggtagttatgagggacttttttatagctgtatttggatattgagaatattttgttatgtttcttgatctgtaaaatgccaacactttaaagctagtatgtgttctaaagcccctccttttcatacacactctttgaggctacgtctgcttgggtggctctttgcttttcattcaataattacctttctcagtatgctgcagagagcttggaaagtactgatgtctcattcagtgattcatcctatttattgcctaatttagaaggacagtgaaagcactcgtaattactttgtgattttccacattgacagcttagctaagatatggcaagtcccgaagtaattcaaagtactttcgagttctttgcagactgacagagtacgtgcctagaaagaacattacagagacgaaccttaacactagaatctcctgtagtatctgctatcactcctctcccaagccacgggctataaggaaatttcctttatattctgcctcccccaagatggtttgtcagtacaatgaccaccttaagtctaaggtctaggctttatataaccgtatgcttcaagggcacccttaaaagacctcccgcctccaaatctcctcccactgcctaaacatttaaacttttataaatgaatttatgtatgacattaccaagaacatatgctaaaattatttatgataaagatcaaagtaactgtcaaattcttgaggtcatcctttttttgtctattttttgaatccaccttatcatgattctttccatatcttaaacaagccacagtttaattaaaagatgccttctgcatctacatgactcctcttttaaaatgcaaattcttttttttttttattttgaggcagggtcttactcctatcacccaggctgaagtgcagtggtgccatcacagctcactacagccttgacttcctgggctcaggtgattctcccacttcagcctcttgagtagctgggactacaggccggcaccaccacgcctggctaatttttgtatttgtagtagagatgaggtttcaccatgttgcccaggctggtctcaaactcgtgggctcaagcaatcctcctgcctcagccttccaaagtgctaggattacaggcctaagccaccatgcctggcacaaattccttttttaaaaaaaaaacaaaaaaacggagatgtgatcttgtttccaagccaaactgagggtcaggctgctatttctcgtggcccaataacgagatgcagacgaactggggaggaagagagtttttatttctgcaaccagttacagggagaaggcctggaaattattgccagatcaactcaaaagtacaacgttttccagagcttacataccttctaagctgtaggtctacctgtaagtgtgcattcgtctaaagacataagtgattaacttcttttaatctataactaaggtctgagtcctgaagaccttcttctggaggctcaataagtttacttaatctaaatgggtctagatgctagggtgattacccttatcttgtctcctgctaaatcataaaggtttggggagttcctttagaccccaataaacttgtttgtggaggcctggggagtttcttcagactcacaataaaacacttgtttaatcctaaaagggtcctgttaagaattccttcattagtttgtcatgcttcaaggcccaggaaaagcctagggaaaactcttggtgggctatttgttacattccagcctttgtataagagcactggctcaatcagcttttaatgtttaacttagctactcactcagtgctgggacagttgtaatggaggcctacattagtgagacctggcctgccacagtctcgctatgttgcccagtctggtcttaactcctgggctcaagccatcttcttgcctcagcctctcaaagtactaggattataggtgtgagctactgtgcctggcccacaaattctttgtaagaaaggagttaggctgggtgcagtggctcacacctgtaatcccagcactttgggaggctgaggcagatggatcacgaggtcaggagttcaagaccagcctggccaagatggtgaaaccccatctctactaaaaatacaaaaaattagctgggcatggtggcaggtgcctataatcccagctacttgggaggctgaggcagagaattgcttgaacccaggaggcagaggttgcagtgagctgagatcgcatcactgcactccaatctaggtgacagagcaagactctgtctcaaaaaaaaaaaaaaaaagaaagaaaagaaaaaagaaaaaaaagaaaggagttaagccatttgaatccatgagcatcttaggatgagttcatgtggtttggtggtcagagcacggccgtgaagtcatatatctgggttcaaatcccttctcttccatttattagaactgtgaccttggtcaaatcccttttattatttgggcctcagtttcctaaggataatgtttcttaattcatagagttttggtgaggggaggtccagtttatgtggagtgaggggaggtccagttatgtgtagacatcgggtggccggctttggagattccaagctttatcagaggttggtaatagggtggaaagagcagtaggaagtgggcataggctagacgacttatttgtgctgttttaatgtggccatcacaccttttttacccatctgatatatttattgagggtagctaatgctgatatggaggaatagagctaaagcccttgaagctacctgtaggtgctgccactggagctcatgaataggccaatgtctaaagaggtccttgaacacaaacttgctgaacttatacttctatagagggctatatctaggatgctgctaatgataacaacaacaacaaaaaaaaatctgacatctatgtagtgtttattacatgcgaggttctgttctaagcactttatatatataaattccatttcatcattatgaaacccctaagaggcagatatgactattatctacattttacaaatgaggaaactgttggatgacagagatgtgatgaagacagggaatctcatattttttaggtcttttagaagcaggactttgatctgtctctttgctcctaatcttagcagttgcctttctagtaacagtatacagtccagtataacagccactgcattttaaatctggctgagtcactaagtctcaaggttccagccatggcagcctggatatatagaaaagcccaaataaatagggatagggccagcagtttagtgaggggacagcagaatttgtctatggagctcaaatccatgctgtcccagatcattccactccctcaaacaccctgtgattgttaattttatgtgtcaatttggctatacagtagtcatcacttatactcaggggatatgttcaagacccccagtagatgcctgaaacagcagttagtacttcaactcatttgccatcaattggaacatgtttctgttcatgtccttcacccacaaatgtaatgtcttttctaccttaactaagcacttgtgaaacattatggccatcatgtttgcagtttgaggtgggacaggacaacagaactaaatgaatttctttctcctttttcacaatttcacagatagaagatttgctgttactctagatcttagcaacctcagcatacagtttttcttttgttcgttaagtgaaaaactttcacattttcacttaaaaaagcattttatggcttttctttggcatgtccaaattgctagcatcactactcttttactttggggccattactaagtaaaataggggtgacttgagtataagcactctaataccacaatagtcatctaataaccaagccagttactaagtgactaatgggcagtcagtgtgaaagggatgattcatggcctgggcggcatggagtgggatggcaagaaatttcatcacactactcagaatgacccacaattaaaaacttatgaattgtttatttctggaattttccatttaatattttcagaacatggaaaccacagaaagtgaaattgtagataagcagggggactactgtactttggtgcccagctgtttgtcagatactagtctagaccttgctatggagggtttttgcagatgtgattaatatttgctgtcagttgactttaggtaaaggaaattacccttgataatgtacatgagcctgattctatcagttgaacaccttaagagtaaaaactgaggtttcttcagaaagaaggaattgtgctttgaggctgtgacatagaaattctgcctgagtttccagcctactggcctgccttttagactttgaatttgccagccatcacaatcatgtgagctaattccttaaaataaatctatttatgtacatatttcttattagttctgtttctttggaaagctctaattgatacataccacatggccttctctctttggcagtgactatttactgcagtttgaaaatgagcatggccctccccctgctacctgcttaatatgtgtgatgtggagcaagctattgagccacttgggaccttagttcctcttctgtcaaatgaatatatttgatccctaccttactggctgatattcagaaaacatgataactggtacggcatgggctccaatcaatcagaatgtattctggtaaaaaagacaactggtcagccatactaattaaaaatcagccctagctcatcatgaggatgcattgtgtgtgggtacatcttacaaactcacaaactcatattcttttttttttttttttttttttagacagagtctcgctctgttgcacaggttggagtggcgtgatctcggctcactgcaacatctgcctcccaggttcaagcaattctcctgccttagcttctggagtagctgggattacaggtgcgtgccaccacgcccagctaatttttgtattttgagtagagacggggtttcaccgtgttgcccaggctagtcttgcactcctgacctcaggtgatccacctgcctcggcctcccaacaaactcatattcttattccaaatttatagttcttggtagattgcaggaatgtgtgtttttaacaagttctccagagattctccttattgaaaaagcctggaagatactgaaatgatgtccagggtctaatatacatggtaggttctcaatacattttagaaatcacttcttcccatcaaaaccccttgggacaaggtgtgacttaattagttatttcatcactggaacaagaacaaacctctaactgatgacacactcagattaagagaaagtacatgagggttataaatcatactgcaatgtataaacattttattaatgtgaactctagtttgtgaaaatggggaattttcccacaatgaagagaagaaataaaaagagagtgatataatgtgggccaggtggcctctgatgcttcaatctagaagttcaggaacctgggttcactctgactctcccagaaactagttacgtgactatacacgagacacaaaacctctctgaacccccatttgttcatttataaaatggagattttgaaaataagagttgcccaatttctatcataggatattttgataatcaaatgggactagataccaaaaagagcatttagcaaatcacctagtccaacttcctcattgtatagaaagagaactgaggcccccaagagaaaagggaaatgctcatagtctttaagctattcagggtcactcctatgagtggcattatgatctcttaatgctaccacagaaaaagcacaactttgaagtaagtcaaacctaggtttgaatccctgttcttgcactcgccctgtgaccttagacaaggtacctcaactctctgttccttagtttcttcaattttaaaataggtacaaaaataattcctacttcatagggttgcattgaacaacaaaggatggaaggctgtggcaaatagtaatggcccagtaatgccgatgcttttcattcctcatccagtgctccttctctaattctactgacatctcatgccagtttccagatcacatggagtccctgtgtttccttgtgatagaaaacatggcaagtgtaagagtggggtcacagtatggagtgggggtaagacccttttttggtagatacatcaccattttcctccaaagaatggacctgtgctcaggtatccaaattatgtgctaaggtccacttcttcatgaaaattcttctggagtttagatgacttgtcaacccaaaaaatattggaactgcaatatgtatggttcctgtgattggtgctgagcctattcccatgaaaaagagggtctgtttttcaaagatggcttttaaatgacatatgatacatctgctatcagcctggccttagttcaaactctcatgttcaatagagaaagagtcgttttctctttcaaccaaccaatttaatcttttcaagatgtgggcattgcgtacaaaaaactagggtgctgaatgtggaccacagagctgtaggtgaaagacccaaatactctctccagaatcatgtgttcttgactctagttgaacgtccaattggacagtacagagttagaaaaaattctcctacaatttcttgctgaaaacccaagatttatgctctttgactaagacagttctctgctaggaattgagcctgagaaaatgatttaatgttcatttatttgacaaatattcattgagcatctattatatgctagttactattctaggatctgggatacatcagtgaacaaatgagacaaggggccttgctcttcttgattaagttcaaaataggaccaattgataataataaaaataactaagtaaatgaggtcatatgcacagatgatgataagagctttgcagaaaagaaaaaaatagatcagagtccttgcatgtaggcatttccatattgtggctgttgtgtaattgcactaattgtcttgcattcagggaatgagaagattgagtgcattatggtacattaactagaaagaatgttatacatccattaaaacaataaatgcaaaactatacagcaacatagatcagtgtttataaaataatggtaaaaggggaaccaaactgcatatacactataattacagctatgtaacaaagtatatgcacatatgaataaagattgaaaggagatctagagaaataaaagcaattgtgttcaggatgggggattatgggtacacctacttacttgtaaaatatcctttgatgctgtgctaattatacattatttaagatgaaagccaaaaagccccaaaaggataaaaagaataaaagatagggagcataatggttgcctgaatgctgagttaaagagctgtgtggggaaaattactttctgtgccacttacttgaaaactagctttcttttgaattcttggaaatgagctttggtcacccataatgatcagcctcagaatttttctcctaagtgccagagctgaagcttaaggctgtatatattgtacactgcacaacttcagggggcaccatttacatcgtagtccataaaatggtgtttcctgtagttgcagagtatacaatttgcaaaatcatacattacagccctatcaagagctagtaactcagtattatcagccatggctagtttggaacataccttatccatctagcacatccctgattataaaggctgtattgagatataatttatatgccagacaatttccccatttaaaaggtacaattaggtggttttagtatacgcacagagtgtgtaaccatcaggacaatcagttttagaccccgttcataaccccgtgaagaaatcatgtattctttatccataacccctaaatccccattcccatcagctctaggccattactaatatactttctgtctctatagatttgcctattctgcacatttaatataaatggaatcatacaatatgcagtctttcgtgattggcttctttcccttagcatgttttcaaggtccatccatgttgtagcatgtatcagtccttcaatcctttttatggctgaataatattcaatcacatggttttataaacaaaatcacattttgtttattaatcagttgatggatatttgggttatttctatattttggcttttgtgaatactgcggctgtaaacatcctaatacaagtttttgtgtggacatgtgctttcatttctcttgggtgtatacctaggagtggaattgctaggtcaaatagcaactctaggtataactttttgaggaactgcgagactattttccagagtgtctgcaccattttacattcccaccagcagtttataagggttaaatttctctatgtcctcatggacactggtagtatcctattgtggtttagatttgcatttttctggtgactaatgttaaacatcttttcatgaacctatagaccatttgtatatcttctttcagaagtgtctattcaaatcatttgactattttttcatttgggtgatttgtcttcttatcattgagttgcaagcattctttacatattttaggtacatttcagatataagtcccttgtccaatatatagtttatgtatatatcatctctcattatttgaattttcttttcactttcttttttgagatggagtttcactcttgttgcccaggctggagtgcaatggcaccatctcggctcatcgcaaccttttgcctcctgggttcaagcaattctcctgcctcagcctcctgagtagctgggattacaggcatgtgctaccatacccagctaatttttgtatttttagtacaaaaatggggtttctccatgttggtcaggctggtctcaaactcctgacctcaggtgatctgcccgccttggcctcccaaagtgctgggattacaggcatgagccaccacgtctggcctcttttcactttcttaatagtgtcctttgaagcattaaaaaatcttaattttgatgaagtccaatgtatctatttttttcttttgttgtctaagaaaccattgccctatgatttacccctatgttttcttctaatatttgtataatgtaaacactggtatttagatctttattcattttgagttaacttttgcatatggtgtgagattgaggctcaagtttgtttaaatgtggatattcagttgttctagcaccatttgttgaaaagactattattttctccttgaattgtctcagcacccttgtcaaaacttgatttattgtaaatatgagaactcatttcaagactctcagttatattttattgatttatatgtctatcattatgccaataagcagggcatcatatgtcctgcttcctgtagcctttgaagtcaggaattatgagccctccaaattcgttctcctttatcatgattgttttgactattctgtgtttcttgagtttccatataaatttaagtattatgttgttaatttctataaaggagtcaactgacattttgatagaatttccattgaattcatagatcactttgaagagtattaccgtcttaacattattaagtttttctatctttgagcactggatgtcttcccattaatttaggtgttctttaatttcaacactataaaagttttcagcgtacatgtcttgaacttttgaatgaattgttgaagtttcagaagacagaacctggggagaatatagaattttatcaggccaacaccatctatgatgagataatgagtttattctgtgaagacacaactcgtctcccagataaaccatgatcttgttagctacatcttggccatgtgatcttgggaaggttattaattccctttgagccccagtctcattttcaaaatgaagctaacagtactttgtagggctgttgaaaaatttggatatgaaaatgcatctaaaatggcccaaaatagagcaataaaaatattgatttccttttcttcttccatttctatgtatttccccagaagttattgttgtataataattattctggtcaagttaagataaaaaactttctatcttaaattttctaagcaaccaatacacataaatgcagtttgtcttacatggatatataatttgtaagcttagcccttaaaattccctgagatataagagcaatgtacaaaactcaactgaatttctatacattttcaattaatacctttaaaacaaaattaagtaattccacttataatagcatcaaaaagaataaaatatttgagaatacatttaaccaaggacgtgcaagccttataaactgaaaactgcaacactttgtttaaaaatttaaagaatatctaaataaatgtgaaaacatcccatgctcattgttgggaataatgctcaaaatcctaaggagactgaacactcaaacaaaggagtcttagcaaagcaattttacttctgtgcagaggggtgcttctccttggccagtcgccatgagagcacacctgaacaaaggggcaggagagcctttattcctgacgcaagtcctgcccctgtaccctttctccactggctagggttgggtggtgcaatctgaactaattccggttggctagacatttgaactttttttttagataaggtgggcatgtaagggagagggtaaaaaaaggggaaggggtgtctgcaatgagctagagagctagtctcctttccaaattaggaaaggaatgtgagctggtactgataagcctggtactgtggcgtgtccgggtatgtaacaaaggcagaaaagacaaaaaggaaaaaggggtgggtactatgaattaaagaataaaggattgatcaggctatttgaagagaaacctcatcatatcccacatcatggatcagaatatttaatattattaagatggtaatattctccaaagtggtctacagactcagtgtagtctctgtcacaataatagtgtgcttctttgtagaaattggcaaggtgatcctaaaattcctatggaaactcaagggacccataatagccaccataatttagaaaaaggagaacaaagttgaagctgtcacacattttgatttcaaaagttactacaaagcaagaataaccagaacaacgtggcattggcataaggataaaataaagataaatggaataaaattgagagtctagaaatgaactctcacatttacaatcaactgatttttgacaaaggtgccaaagcgattcaataggagaaagaatatccttttcaacaagtggtgcggggacaactgaatagccacatacaaaagaataaggtcagactctgcctcacattgagatagccagatgggagcgtgtccctgggaaaaactccaactggcctgagcactggagtagagcctcaggaatttcgtgccttttgcagttgagaggagcctggcccctcctcttcttgtgtggaacctaggattcgagctgtgggcagaaagtgctctagcagggactctggctttgaaagagtccctttttcctccttttcttcctttacacccaataaaacctgtcttacccttcaaactgtctgcacgcctgaatttttatggctgtgggacaaaggacctcatctttagctgaactaaggaaaaagtcctgcaacatttttggcgtgcaacgtagggacttgagaagcggtgagtgaaatggggactcaaaacctcttactgttgctcctaaaccttttcatcctgggacttctgagcttatgggaaacagtgccccccaccggccctcccaggaaggaggccttttcatggccttttccttcctttttccagatggactggtgagccacagctgcctgccgctccccactccgtgctcgtgcttgggctgggatgcatggcccaagggtcccacacagctggttccactggacagtaattaagcttaagcttctctcccagctggaggaaccacttgcaggagaataagaggttcttccccagacatttttaaaccttttttctttccccttctctaccctatcaacaagttaacctttaaagttttctttttcttttagaagataggccaaccccaacccaactatcactgtttgcattctctgcaaagtttaggttgtgaaaccaagcctccatcttgttttaccgcttgagggcatggcttctaactctgggggcaaggctttgcttagcaatcctgcctcagaggatgagccctctctggttccatagctgcatgttttcctagccctgtctcttaaagggccccatccagctactgggtttttttctgcctgtctgtgtatgtactgtgtatgatttctgcaaaatgagctctaattaatttggcttaaagaaagacaagcgcttggattaaatatttttaaaagggaagataaaagctgtggtacttttcagttcatgtgactttaatctttgagaaataaaaacagacttaaagattattggtagaatgcaggtgtcattaaaatgtaaatagatgaaataaactgtgcaggtcagatgcaaggtttgcccaatgtgttaaggttacaaactgctttttggcttttgagaactatctgtcttgcctgcttcacaattggtaaggcctggggacatatggaaccaaccatgcccttcattatgctggagtcaaaccttgactgcacttaacacacaaagcaaattaacaagttttaccttaaagttaaaaatccgctaggagttaccattataatacgtaattgaagctactgaaagtaaatttacatgcaagaagtgtaagaacagtaaaatgtgtttttttggaaaaggttacaaaaaggcatggaaatgtaaatttttgcctaggcttaaacgattgttttgaattaggaaaaaactgagggttcaaacaagtggtggaagaattgtagaaattaatctcgcagaagaggttctctgtgtgaacatgttgactaaattcaaaagggctgtaaaaggtttttgcttctttaaaatttatgagtcatcattttggaaaaataaataacttatggtaatctggaattctatttcataatatcaagtgctttaaacacatttaacagtcttcccaaaatcaaacttcagtttcaaagttgtctttcttgacaactttcagatagtccagagggcccctggaatgtccagaaaagagaggtaaacaggattatttgacatgtctaggtacatgagattgccaaaggtgatgttcaatcttttttaggttatatcttggtgaataatgctaatatatgttccaaaattgtatgggatttctaaaattctaatgtctaagtatatgctatcaatcataattaaggttgctatgttgttatttgtaaaccacggagataaccaaacttctttgtcaattgtgtttctaactataactgctctagacattttgctattcacagacaattgttgtcttgttttaatcctttcaaaagatggtttataataagctataggactctgacaggtgctctcaaatacaatttctgattgtgtttgagacaattgggtttctgataactttggagattgtaacattggaataaaggaaaatgtacagtattcacgaagagctgaaatgttcatgaatatcacgtgaaacaagagttaactaactggactgaactcagaaatctgaagcaacctttctaagacttttgcttggaatattgctgatccgtgttttgtttttcagagtcaaggaaacttatgttaaactatttatagccttttaataattgagtaaggtaatacccactgtgaacaaaatttggagcacgtttgtttctctctgcctggttcctctaaatttgaaaactatctggagtgttcttatggcaatatagttgtttgcatcagtgcaataagaatcaatttttcttttgcagcaggacacaattggagaatgtggtaattttaccaaggctttgactggaagggtatgcttccctttaaggagtcaagcttggcttgcagagccgatagaagcccagtggggagactggcctcataccctcatctacccagtccctgtacagggttcctgacctgtggtcaataaagaatgtcactttctaacaggtccaagagctccaagtttatcttgggaccttaagaggagaggatcacccaactcacatgtacttgaggataaacccatggctgggcttggctttaaaaggtcttttttttttttttttttttttttttgagacggagtctcactcttgtcgcccaggccggactgcagtggcgctatctcggctcactgcaagctccgcctcccgggttcacgccattctcctgcctcagcctcccgagtagctgggactacaggcgtgcaccactacgcccggctaattttgtatttttagtagagatgaggtttggccatattggccaggctggtctcgaactcctgacctcaggtgatctgcccgcctgggcctcccaaagtgctgggattacaggcttgagccaccgcacccggcctaaaaggtcttatatgagatcccttggggaacagagttccagcacagacaatctaaaaggcctttgtagaaataatttttcttgcttcactttatgcaaataataaggccaagtataagactaaagtttattttgcaaaccactcagtcctaggatgatttggttttttaacaaaaatgaggactggagagagagaaaaattatgtttcaacacttatcatacatttgtcactaaattctaaactcactagttgtttttaagtttttgcctacatgttagactaaccctgattgttccgtgaaccaaccagcaatctccaacttcagctcagagagaaaaaaagggatgggcaatgtagaaatccagatcaatattctagttctgagaaattatcctacaaatcctgccaggcgattggaataaatagggtgcccatcactcaggggtttccttttgggaaagtaagaccaagggagctaaccaaagccaagcaccatgcacccaaatcctagcaagcatgactatagccaccagttatctgggcatgtcacaagacatccttttctctcctttgttggaggaagactcaatcccacagctttaccctagcattcagcttataataaggagtccatgcaaccccccaccctgagacacatttttgtcccaaactcaattccaagctttgggtcaaagtcctaggaaagaaaactggatctgaaggatccagaggtggatgataatgggaagttaaaaggcacagggcaggtgagcatggctgattcctgccgatcaagccaagcccaagcttcttgtttcatggataaaggccacgttagtatccatggcaaaaatgaggtctagggaatccacggctactgaaaagcaggggagatggggcatatgtgggtaagagtgggtgattcccaccccgtacccacccttcccccgcttcattggtgcaagccgctgtgacattcatggcgggacgtgccatggtcgccaggactcagggatgcaaggatggaagagggaaagacgatgctcttccctctttccctcacgtaccccgggtatctgttaggaagagaagggaaccagggatacctgctccactctttctagaagggtagccattcatcttcagtctgtaccctttctgagtgcatcctgaacccctgggactcctttaaaaggcaccttcttttttcctttctcctcttctgtcttcttcacagataggtaattgtgtctctgtactatgggatgctcccctcagatgcatcctccaaactggtaagagttaatttcccaaaccttaaactggttggcttaggattgggctcaggggaaggggaaccagaagggtaaagtgtttttttaccggtcaggcttttggccctcctttccatgtgcaaactggtaaaaggcctcaggatttctgagctgtccttacccctccccttgtttcgacttgatacatgttttctaataaactggtttgtctcttcttgccttcaggtcatcaaactccaagtggccatgcaaccagagcctctgatgatggccccttctgctgggaaccttacacaggcctctgagggagctttaactgccgtttccccaaaacagcacccctgtcagcaggaagcagttaagatcggtcttcatacttatccttattctaagggcagttggatgtgcttctttagaggggcgaatgaggcagccaagtgggagggggtccctggaaaaactccaaccagcctgcacactggggtggagccttgggaagttcatgccatttgcaacagggaggtgcctgactccttctctctgtgtggaacctgggattcaagttgcgagcgggaagcgctctagcagggactctggccttgtgagagtccctgtttcccccctttctttctttacatccaataaaaccctgtcttaccattcaaatctgaatttttgtggccgtggacagaggaccccatctttagctgaaataaggaaaagtcctgcaacaacatcaaatacaataattaaggcaaagtggatcaaaggcttcgtgtaatagctaaaaccataaaactgttagacggaaacaggggtaaatccccgtggccttagatttggcaatagtttcttacaagtgataccaaaagcacaagcaacaaaagaaaaacagataaattgaactttatcaaaattgtgagtttttgttctttaaaggacactatcaagaaagtgaaaatacaacccacacaatggaagaagaggtttataaagtatacactgggtaatggcctagcacccagaatctataaagtacccacaactcaataacaaaaggacaaaaatcggaaaagggtcaaagtcaacatttctcaaaagaagatgcacaaatggccaacaggcacaagaaaagattctcaatgttttagtcattaggaaatacaaatcaaaaccacaatgagatacaactttacgtatactacaatgcctataatcaaaaagatcataagaagcactggcgagcccgtagagacatttgaaccctaaaacactgctggcaggaatataaaatggtgcagtcactttggaaaacagtccagcagtttctcaaagagttaaatctagaattatcatatggcttagcaattcctaggtatatacctaagaaaaatgaaagcatatgtcttcacaaaaacttgtactcaaatgtttatagcagtattactcatagtatctaaaagtagaaacaacccaaatgttcaacgtaatgaatggataaataaaatatggtataaccatacaatcaaatatcatttggctgtaaaaaggaatgaagtactgaggcatagtacaagatggatgaaccttaaaattactatgtttcacgaaagaagccagtcacagaaaatcacatatatggtgcctttcatgtgaagtgtcaagaataagccaatctacagtcagaaaatagattagtagtcactgctagtggctggagggcagggggaatggagagtgactgctaatgggtatgagctttctttatggggcgatgaaaatgttacaaaattggtggtgctgatgattgtaaaactctgtaaatatactaaaaaacatagaatcatagactataaatgaataaattgtttggtatgtgaatcatatatcaaagcacatgttctgatcaaagtggaaaacaatgaaataaaaagttccctggagcagagttctggagcggtgggagttaaacaggtaaatgtaattcatataagtctaaattccggaaaccaggactgtgtcttttacattgctgcagtgcacatgtttaacaaagttctgtatgtagccaatgttaaagacaatcacagtaaaaaatgaagaaaagctcttggaaccaaaccgtccatcaatttgcaactatgtagaagagaagatgttatgaaatcatggaagtctccaagagccttgacctgtaagaagcttgtaaaattgaattgtgcaggtgccttgagacttggtcagaaacttgctcattccagagattccctggggttcagatagctgacaactacgcctggagaagttagacctgttctaaataccctagagattctagcactcttaaaaccatctccaggctcagaatctaactagagaattgctgaactaacttgctttccttgaggagcttcggactacttagaagggaatcaggcttggggtcagtttttgagactaaaagtcctgaaatctgtctctcctggaaacgctaagggacattttttagtaatttttcttccagtaaaatcccaaagtctaatttgagtccaaatctttggggttcatccagaagcaaatggctgctaggaacatagactgtttgactccagagtgagtaaatgttagatagattaaatctttactttatctggctttagatttggtcttgtatgaaactgacaataaaataagaaacatggtttaaaccatacaaatatctgtcaagaagctagtgtgtctcaaatcactttcacaagggttaaagataaacctgtagccatctgatttctttgccagtaggaatggggtacttggtcatagaatgaatattatttatatttgctttcaaaacccttgatggtttaaaacatatacactttgttttgtaggatagattacttcccacaaatgctcatatggaagactctaaaactaaatagcatttaaagtgaattccatgaaccctattgatttccattatgaaatcatagatggatttccatgggaagaattctcctaagtgactgttgaaaacttttgcaaaggaagatgctatcatggtggtcatctctatgacctactgaccagtgtaaagaacactgctggaactttggtgctaccaactgtcagctattagttatctgcccttacttagaattcagttaggaccaagccaatccaattcatgtctcctcaaggattcttacacatgcagatagtaaaataatttactgtttaattaggaaggccctagttagtattcctggggttaagcattaacacaaaggctgcaagataatttttattaaaaggatactatattaggctactgaaatggcaaagcaatgattctcaactttcagagggcaaattgaaaatacagattcttgggccacacactcagagccacagagacagtcagataatcctaaagcaaaggacatccaagattctgcaggctccttggatacataatccagtacctatattctctttggaatgtgataatatgggattctatatataactaacagcctataaatactatacgctgggtactgtctacacacattacatatattaacttaatcctcacagcaaaactttcaaggagatactattattttcatccccattttatagatgagaaaactaaggcagaggttaagtaactttcccagggtcactctgctgataaagtagcagtacttagattttaacaaatcatcatttattgcagaaactatgcttaatctgctatgggctataacactttgcttttcctacaccattcttttttctagctgtatcagatttttttaaattggcagttttaagagtgtgctaacaaggtcaatctctgtgaaagtcagaggaatgctctctgcactaattaagagataatcacaactaatttctcctggcctcaataatacagacatggtctgtctgaatatttgcattcttccagccaatgtccatgaatatagtttgggcatctattctcagtttgacagtcttgtgaaggcaatatagtctatgcacccaaagactggcacagagtgggtcatggttctctggggcttcctttcattttctgtggagatagagaggaatgtatcctctgaagacagctatgggatttcaacaagaaaacacctgaccagagacattgagaagtataacctagattcatatttatttaatacctcttgagtgcctgctgtatggaggtgctagggttatggtagggaagaaaacaggcaaccccctgcccttggggatatccttatttaatattcaacatgtctttaagtattattcttattagaattataatcttccttgaaatatgaccctccaaattgcctcagtttccccacaagtaaaacaaaggtgggattaaactccctaggtaagcggcctctgagccagagcttagtgtgtaggaagtttattgggagtgctatcagaactgacacctgttgaggaagtaaagaagcaagactggctggagggagaggctgaactgtgatacagcctcaacaaaggctgcagatcacctcatagggccctctggaattgagatggtcatgctaaattggagtcaggggatcagggataaggtttttacaccatccccccataaggcaggtcattggttagtgctgtcctgtgcaagacagctgtcttcaaagaatggaaattcccaaagagctattttcaggcagcacttccagcagctaggggaagaagttatttagtcctcaagggggatttggacgatacatcacagcatccattacggaaagactggactcttatctatgacaccctgtccagatatcacatcctacaatcttatgactgtaggggactggtaatgtcactgctgtccactccgtcaagtagatatcctaagtgtagtgagtgcccctgtggcagtgttgccctgggatgctgtttcttacatggctacctgctgctctgaatacccaatagaccttgattggcaggcccaatctctcatcctgcttgaagcttacacttgcacctcatgagctctgtgggatcttcagagtagatgtcagcgctttgagttccatcacaggcctctacagacataatctgggtgcagcgacaccctgcataatcttgtaaagcaggattttgctaattttctagagagctgaacctggcttctgtattatgttaattaaaagcatcctgatttatgagagttgtaggcaaaggcatgcaatggctcagggatacacaatttctaactttgtgctgccacctaatggccatccagctgatgagcaaaacagaaggctgggatataattaattgaatacccaagaaaaggaatctttaatgtgggcttccccttcatcccccacttggagatgaagaaacattcaaagtttcagcttaggttgtcttaaaacctgtctccatgaatcattccttccctggaaagccttctaccaatctttcaagccctaactcagatgtcctctctttaagaagccttcccaaccaacccagcagtcagcctttcctcctctgggctgccctggaatggggtatgtccctttagcatagcctgaattgcacttaggtgaattgctttgtggtatatctgaccaggctgagctccagtgaggcaagttgttgtgtttttgttttgtttttcttgcttcgtacatagtattttcccaaagagtgttgtaggtctacactaaccattcatttcactctacttcttgctctttaaactgtttctgggtttgtcatacaaatgcatgctggaagtgatgaaaaagttgtcaaagtagtttgcactttgtgacattctgtccctatttctctttctcacttctgtctcacattaagtttttagagaactgcctcacagaggcaggctttcactgtccatgggaacttttgtttcatgacccaattgggacacccctcttttacttcattgtgactgctgccatttgaagaacagactggagttccctccacactccttgcttcttaatatatatgcaatcatctttaggaatatcaagaccctattttataaaaacccaccaaaaccctattttgtaaagcactctcaccattctggtacccagcagcccactgcctgggaacatccaaatctctggaatgcattgagtaacatgttcagtgtagccagtgcttctggtccacctagcctgacccgtggaattcacttactaactcacagacatgctctactcagaactccctattttccttcaattaaggctactgagcctacaacttcccctcctacccagcagcgatgccactccagctgttaatcagtgtttgaagaaaccatgggccaaccaagaggcccttcagcacatcttgaagtccgagggagagcattcaaatggaatctgttaactggctctttcctccaatgcacaaataccttccactgtctttttcacttatggattctgaccatttaacaggcacttatcaggtgctcaataaatgtttgctgaataagtgaatgaatccatttaggcagaagatttgagggtaatacctggaatgttcatcagagagcaccgtggtcttcgggctttacctgttcagctgcatacatgttaaccccatgtacctgaggtaatggagatacaaagcacccagactggcttgagagagtaaaggaaatcttccagagcaggtgatggtagagcccaccttggcagcaaagtgagagttttgccaggtagacaaggaggggaaggaaggaatgacaggaacagggaagcggatgggcaggtaagtgtaaggaaccatgatgggcttcttccacctggtacattcaggagactatgagtagtccaggttttctggagtgaggtataaagtgacagggcagggggaatgctgagagatttgaccaaatagagtcatggtattttaaaagcaaaaagccaaaaacatcaccgcctgctgaaaaatacacaaatgttttcctccaaacttagggaagaaaatccaaatccagcccctgcctccctctctgccctcagctgcctcttcctgcttcctctctcattctgctccagtcacaaaggcttccctgcttgccagctggatttctaaaaccaagagaacctcctctggtctctagcaggctccaccatggactcagactagatctttctatgaccttcagagtcttcttccccaatacccgctatcctttcttgaagctctcctataccatgtttgtctcaggccatatgagctactactctttttactatttttccagataaacccagatgactggcagcacactagtaatttcaccctcattgtaggtgaaattcaccaaggacctttttaaaggaggagaatgatcctagaacaaaatgttttgtgaggtagtgagcttcccatcaccagcgatgttccagcagaagttaaatgcccgttcccagggaagttgtaggaaggaatcactcactgggtgggatcacatagaggacctcttaagattttattctaactgtacacaaacacctagacagacattataattttattaaaagaaggtgatataggtatcccgtaattaagcaaaatatataaaatgtaaatttttcaaataaacaaatttgaaggactgtatttcataaaagggatccatttgggtgactttaactagaatcctaaaatattacaggtaaaagggactttattcactttgttttctaaaacaagaattctttctaatagaacattttagcacaattacatttgtttagaatttgacctggtacatagtaggagataaatacatatttgtttaatgaatgcataaccaaagaaaaaatgtgatgtatataacttttcaaaaatacagctatcgttccaagtaagattcaagtgtacagttttggctgagaggacctagtttgagaagttgctgttgagtgcaataacaatagtgaaaggtgcttgttttgtttaattttggtcttgttgtttggtcattgttggagaacaaaaggtcaacagtattttctggtgacaattatattccttttaaaaatgtggatcaccagtaaaacttccaaaagaaaacatcttcacgtgtccttaggttatgtaaatgtctattgaggtgctcgagaggaggcatgttgtctcacagttcccttattcagaatgtacctgcccccaccccttatacatatgacccaccccaagcctcagctgcacttcaccacctggtgagtggagagggtgccaggcatggtaagcacaatccccacatggcaagcccagacagtaaaggtcagatctgttgggagtggctgggggttgagattatgaggctcatacctatttctctaaactcaacaccccagtggccaatcttttcaagaaataggagggagagctttgaatggactctggattcatgaggcaacttttagggtcccttagagacccttccctgtggcctcatcttttgctccccctatccctttatcacaggaattgctgcctctaatactgggatgggatctacattttcaagggacggttcctgttgcacctgctttttaaatgaagctgactctagcataatatcagctgcttggaaaagaacaccagtcttccatcaaataagctgtcttcgttgcctggcacattgacttgtcaagttccaaatgtcatgacctgtgaaaacttgagacaactacaaagcaaattaatgccggagaagtgggccctaggacttcagcaatttgagattctgattacaaaagactggaaaaggaaagacccttggtagtgctcaacatgaaccaaaacacaaatagactcagcatttttaatgttttaatgactagaaatggaatcttcacatattgtaaaaagtgaacagaaaagaaacattaaataagaataatgcataatctgcgatttttttttttgagacagagttttgctcttgttgcccaggctggaatgcaatggcgcgatcttggctcaccacaacctccacctcccaggttcaagcaattctcctgcctcagccttcccaagcagctggaattataggcatgcgccaccaagcccggctaattttgtatttttagtagagatgggttttctccatgtgggtcaggctggtctcaaactcccgacctcaggtgatccacccacctcggcctcccaaagtgctgggattacaggcgtgagccaccgcacctggcctaatctggaatttttattgttttgtgttaatctgtattttcaatgtttgtataatgtccatgtgtttgtagtaataaaataataaggcatttaaaactatttactttcaaccttcacatcattttgtacttatgttactttgtaagcaactatgtcattaaattctggattctgaatccagtaggccctttcaggtggaccagaaaccacagtgagagaaggtggggaatctgcaatgagtgtctaaataagttacttcagatccagtacctatctggttgctaggtttttctggctcccacaggtggttccctcatcctgtcagagtgagcttcatgctgatcctttgtgtattgctggatattcaggacatcatgtttggaggtccacagatcctattgatacagaaggattgccagagtgcaggccaccttagggtggccaccatagctgccatggaattttgttctagtgagagagagcaatgaactatttatgcctggaaaattctgtagaagtcacttaagtgagacatcaggcttgatataggaaatgaggcagccaggctgtgctcctgggatctggatgctatatcctgacagcctgtcagtcaaagattcatgtgcagaggtcagcagaatatgggcacagccgactgttagctatcaggactgtgtgtgaactatgctgacctgatatatgaacttaagggcccagtcagagcccaggttctggggcagctgatgtgcccaaggtagattaggaatccaatactggagcaagttcaaaactctcctaataggcgatggtgacatgtttgccatttatcctacaggcagcaagtgagaagtcagtgaggggtttgcatgagaggaaaataaatactctgcattctggacaggcctgtctgatggtgccttggagaatgaaatggaggtgaggaggtgggtaaggggaaggaaggcagggtgagaaacagcaccaaataaagaaatcaaggtgaactgatgtggccctggtctcaagctgtagtagtggagttggatggaggagtggaaatagagttcagagagcattacatttagggatgggctgggctcccacctgtaatttcagcattttgggaggctgaggcagaaggatcacttgaggccaggagttcaagaccaaactgagcaacacagtgagactccatctctaaaaaaaaaaaagataggaatgaccaaagttggtaaacagatagtagggagaaggtaagatgtaaaatgaattccaggttccagctcaggagacaggttgcatgatggtatcatgaactgagattttaggcacaagaggggaaggaggaaatttggataggacgtagagcaggagtggagttagggaaacagttcagtggtctccagtgggtgctatcagccttccaaatgaggatttctagggacagtcaaatacctaaacctggagaggggctgggcagggatcaggtagaggagtgatccacagtcgttgcctgacatcatggacatagttgagctgacactgaacaagtatgagtctaatgaaatgggaagatgaagaagagattagtgaagaatagaaaagggaatgtagcaggaaaaaaaaaaaagaggcgttgccaagaatggcaccttgggtagcatcattatggatatatcagagtcagccagttaaaacacatccttaaacaatgcccatgtgccagatcctgtagtggattctgacaattgtggtccacagaacagcaacatagagtttagtgcttcagacagacattgaacacattttacaatgaaacaaattgttacaaaatgtttacctagtaattgtaagtagaaaaagtattgtcaaggaaaatataggatgctgtgggagtgtagaacagtatggacttaaccaaatctcattgggggggattcgaggagaggtacaaatgccttctctgagaaagtagcacctaggttgaaaattgaaggagaagtagctgttgacaagccaatgggaagagagagaatctcttgcaggaagaagaaaaggagccagtgaagcctcctcagaagaagctaccagagagataggaggagagcactgaagggactattaggaatgctaaatgaggagagagaatatgtcagctccaaacccagaggtcatcagccatggtcacccccttctgctgacaaggtcgcctatgacaccaagtaagccacctccttccacttgaattttggtttcagcaggacaacttctcggccacgggcttctcttgggagcagccagtttgctaggaccagaggatgaggcagggtttgtctatagaggcatttttcctacagaggaagtttttgatggtgaaggagctgttctactttttgactgtggtggtgggcctactgtggtatgtatttgtcaagtctcatagaactgtacacaagaagagtgaactttagtgatttaaaattatacttcaataatgtaagcaagaaaaataatacactctcacattaaaatgcacacttacttgaaaagctcataaaatacataaatcaatttgagtagaaataatagaatattagtgagagtgaaaaagaggataaataagtggagagatcgtccacgtaaatggcctggaaaattatagtttttagatgcgtagtctcccaaaattgatctgtatattcaatgcaattaaaaaaaaacctctatattttaatgtgtggaaattgccaaactgattctaaaatttatataaaatccaaatgtgcatgaaaaagaagattcatttgaaaaagaacaaggtgtgaatcagcttggtgctgatacagactcatttgcatatgaaaaacttaattaatggtaattatggcactgcagaccatgggaaattgactatcttttccataattagtcttgagaaaactgggcctctccctcacatcagaaacaaaaattcattttggatggacttaaattttaaaggaaaagcgtatatcttttgaaatataagactgtatgttcatattttatatgtatatttatgtttcattcacatttgtatatgcataatatatcatagggataaagaaacataatgagaaaatatacactgtcttatggcaatatttttgaaaatttgaatgtattaacaaatgtttgaaaaattttacttaaacttgattcaagatgatacagaagtcatgaagaggtatgtagatattaaaataaatgaatgagtaattaaaaattgtcccaagaattaaaagcaaaaatgaaatactcgaggctcatcaaacattaaaggagaaaatgatcccaatattatacaaagtgttctaaggaacatatgataaaaagaacattttccaatttatatcatgtggtaaaattttgatagcgaatacgatgatggacacaaaaataaagggcaataagagatcaatcacacccatgaaaatagatggaaaatcctcaagaaaatattagcaaactaaattcagcaatgtatgaacaaaataacatatcaagaccaagatgaaataacatatcaagaccaagatggtctatcatttagaaataaattataaactcaagctgcattcataataaaacttttctgatatccatgaagagaaagcaagtttcttaactggataaaggatatctttaaaaaataactttaataagtatcctactaaattttgaaatactgaaagctttctttttgagattgaggaatagtttcccttgatgattctattggagatcttaatttacttagtaaggcaagaatagtaaaagtgtaaggattacaaatgaagaagcaaatctgtcattattcataggtgatttgataatagactagaaaaccaaaaataactcatacataaattgttagacaaaagtatcactactagatcgtatatgtatatgcatatacatacacacacacataagatttacaaaccaatacataggcaaaagagtgatagagaatgagtaaattaaaatatactaacaataatatcatcagaaatcagcgtgggtctaatcaaaagatagaaactacataggttaaacatattattttaatacaaataattattcaactgtgatcaagattaactatgagatttatggaaccttgatatgacaccatacggctagcggaaagtacgcaaggaaagaaacacttggaaggatccctcatggcataagttgtagtttgggccagtggttgtggcatagctccacctgatggcctcacccacaccactcaccctgcctctgctggaaatggaaggaatgcctcttcccccttcagtgttcctccaccagcctctactgagaaagctcacttttattgtgttcacttgaaaaaagaaatgcttaatggaatcacgttgtttatcaaacagcatatatgtaaggatgcagtccaagcagagagacaataaaatgataatggatgaaagtacatggaataaatccaacacagtaaagacctacatggaaaaaaaaactataacctttttttaagagatactcctgttacaggttgaattgtggctctcccgaccaccattcgtatgttgaagttgtaacacctagtacctcagaatgtggccttatttggagatggagtcattgcagttgtaatgagcaagatgaggtcattaagacagaccctaatccagtatgaccagagtcctcattaaaaggtgaaatttggacacagagacagataaacatagaggaaaggccccatgaagagacatgcgaagaagacagccaactacaagccaaggagagaggtctcaaacagatccttccctcatagcccttagaaggaaccaagtctgctggcaccttgattttggacttctagcctccagaactgtgagacaatatatttgtgttgtttaagccaaccaattgtggtactttgttaaggcagccatagcaaatgaatggattctggtactgagaagtagtgtgctgctgtaacaaatacctagaaatatacacatgacgttgggtaatactagatcagcatgggctcctaagtccaaggactagtgttgttatccaaaggggacatttggacacaggcaggcatacacacagggagaatggcacgtgaagaatggagttaagctgccacaaggcaaggaaccaccagaagctaggagagaggcatgggacagattctccctcagagccctcagaagaaacccaccctgccgacaccttgatcttgaacgtgtagcttccagaactgcgaaaggatacatttctgtggtttaagccacccagggtgtagtgctttgttacagcagcccatgcaaactaatacagatagtaataaatgataacttcaattaatagtgagatgtactatgttcactgactgtgaaacttcatgttgtaatagcatcagttctctctgaatcattttaaagattcgatgtgaccacaaacaaaatcccaagcagtcatttttgcgtggcatttgacaaggtgattccaactatgatacagtgatgcagtaggccaagaattccaaagattaagaaaaaggtaggaggagttttactagtacaggcagtcctcgctttgcacctactggaggaccatgaaatgaccatgcaaatgaccatgcaaattgcaaccataccacgcgatatcaataaccataggaaaagttatgctcattctgtgacttttaaatatttttgtcaaaatgttaaaactctcttactttcggttatacatgtataggaaaatttaaaaagtagtaaagctaagtgtcattcaaaacattggacacattgagaattaaagttccaaatatctatggagatcatttaatgtgaaggtttttttttgctatgttcatagcatcccttgataatactctgaagctggaaacaatacaaatattcctctttattagaagtggttagtaaattctggaatgttcatagaatgaaatatatgcagcagtaaaaaataaagaaattatggctactagcatcaagataaatgaccctcattagagtgagcaaaagttgcaaatcgaaagaagtaaacagtataattgcatgttaaaaagtttaaggccaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagtgagactccgtctcaaaaaaaaaaaaaaaaaaaaaaaaaaaaagtttaaggccaggcgtggtggctcacgcctgtaatcccagcactttgggaggccgaggcgggcagatcatgaggtcaggagatcgagaccatcctggctaacatggtgaaaccctgtctctactaaaaatacaaaaaaaaaaaaaaaaaaattagccgggcgccatggcgggcacctgtagtcccagctactctggaggctgaggcaggagaatggcatgaacacgggaggtggagcttgcagtgagccgagatcgccccactgcactccagcctgggcgacagagcgagactccgtctcaaaaaaaaaaaaaaaaaaaaactttaataataagcaaaactatagtgtttaggggtgcaaatgaagatggtagaaagtatcaatgaaagcaaagtagagacttttacgaaagtcaggcaaggggtacatttagatttgattgaatgggatgtgttcaggaagggacatactagcggtttgtaaattacaggaagtattctgttctttaggtagtggtgtgtgccctacagttactgttttcagtgtgaatataatttatatattatgttactgttacatatttaataatatgcttaaaataaaaatgaagacagacttagaaggagcagccagtgtgaagagacctcaggaagcacctgggaggctgtaatgttctatttcttgacacacacacacacacacacacttgtgtatatatattaacatatacgtgtgtaatacactcctttatatggcatgataaaaatctcctgatatccatatgcttgtttcttgtatgttttcttctacaaatcatgagagaggctgtgaaatgtttgaaaaacaatgtaggctttagcacaacaaaatgaattggaagaattttcaatatcctctcttcagtttgggcttttgttgttgtttctgttctgctcagcaaactaaaacatgctgttgagtctgaaacttccagacaaggctgggaggaccagcaaaaggaaaaactggagctagaaagatggggagaaagtcagagaaatgaacacagacatggtacatgctagcaatgcatcaccttttgatcaaggtcccttatgcagactaagggtggcaaaggcaccttatagaaaagcctggactgttcactacattgcagcctgcacggcaagaagctcaactggtgattgccagggattcctttctggaactactagctcatcacatcttcctggaagcatgacctacatgacctggtgatgtcgctgctgcttcccatatagtaaacctgattgcccagacactcccaaagaaggatcagtgggaggagtctgtgttctcttgtttgtgggatgaagcaatctcacctaatcactcggttctcggttggtgtggtgggctccatggaaaatttactgtttcagggagttttgttgaatgagcctttgcccatctaccatccttgtgtgtcttgagtgactactgttctagagattattgtcatgtttcgccactttcatgaggtgagagtattaccccaagcctcagcttcactgtcaacccacctcttcttcttgctaaggtgggagcacatccaaggttcctgaaatggttaatattagtgtcaccttgactgggttgagggatgcctccgtgcctggtgatgcattgtctctgggtgtgcctgtgagggtgtagccagaggcgattgatgtgaatcagtggactgggaggggaagagcccccttaatgtgggtggttatcatccaatcagctgctggtgcagttagaactaatcaagcagaagaaggggactttctctatctctctctctctctctctctctctccccacatttgggaatgtgataccattttctcctcctttcctcggacagccatctccaggatccatggcctttggactctgggacttgcactagcagcctcccgggagatctcaagattttagcctcagactgggaactgcagtattagctttcctgggtttgaagtgtttggacttagactgagctatcctgctggcttttcttattccccaaattgcagagggcatattatggggcttcatctttataatcgtgtgagccatttctccctattaaacttcctgctatataaatatatacacaaatatatcttattggtcctgtcttcgtccctctggagaaccctgactgctgcagttctctagagggcagctcaccctctgctttgggatatggccctcttgaaaccttcaaattctgagattggggcagtggtaaaacagaaaaatgtagagagtaataaagctatctctgcctagccagtcgacttccctccagcttcccttttaaatactggaagtaaatacttaaataattcttttggctccacatattttattgcttctttccagaaggacatgtgcttgcttgagatgcggtagatgtggcctgggtgatctggaggtgtagaggttgtgggtggatgagcgtaagaacatacttgtccctgttactctgtgatcctgtgccctagggctgtactttttccttctgcttagctttttgggcagtgctgattagaatgcaggatgaatttacatagtgggctgctctgactggaatggtttaatacagaaatgagtggggagtgtggatgtgggggtggaaagagacgtgaatctaattttccttatgaatctgcatcctttatgcaatagagctccgcttgcatctgaatagttgtctcgacaacgccacagtgagtgtaaatcgacttaagaaaaagactgctatgacagtggggtcaacttaggagcacagaaggaacacacacagtgttttagcagctggacagtgcagaaactaagggactgtggctccaggaaacacacactcaattgtaaccacgtgctttccacccagagcctcaatatcatatgtgttattccactgaccttccactcactttcaatctcatatttcacaatgaagatgcctttcccctccttgtctggttccactcatttttcatcattcccagatcctctggggaaaagaagccagggattttgaagaagacttctttgtgaattcaaaagcccagttgcctcacatgcctgtggaatccagctgagggtcaatgccaggtggagaggagcctcatgaccgcttcgtggccctttgccctttcccctggggtgcagcaaacaatatatttagaacagcagaggctgctgagcctaagactgagaggacggccaaaggctgggagactgctaagcctgtggtcatggccagagaccagggaagagacaaaactgaaagataggctgctaggccctgactttcgtgccatggtcattctctgccataatataagcacttgctgaaaaacattcagatggcaaaataggtgtaaaatgatgaatatctcctgaccctacacacccctgcaagagctgtgactgctatgcacaccccagcctatgctccctgtagagatagatgtttagatgaggaagcatagacacacgagaacatgttttccttttcattttccttgtacaaatttatgttctaccctacacataaggacggtcctgtagcaggctccttccacatcaggaacattgacagtgtctctgcaaagtctcacccaaacagaggcctctgctctgtgtagcccctgctcaaaggtggccaggcatagccctggctgctctgctcatccctgcacagtactgaacctcaagggacactctcccctgtcaaccctagggagctcctgataggacatagactacccctaccttcacatagaatattcaagtcagtcacttcactggtcactgaaaaggatgtggaggactcctgccatcccccatacacctgatttacaatgatcccttatgggaaagcaggaatccttttgacctggaagactgaattccaggaaatactaacctgtagcccagaaaagaccagcagcccagtgggcttgttcttctctccctctagttgggcctgagagtggccaggggaggaagcttaccagcctgttaaccaggcacatgatacctgggagctagtcctcctgatgtctcccaaaggactgtgaaaaacgagcttttggggggctgcttgtttccctagtactctgctggaagtggtcttctcctggaaatgccttgaaaatcccaagtcctccaacctgcttcaaaggcctaatataccatcttgggcccctggtatggagcgacacacagatctccacctagacttcaattcacaaaaatgaatattatcatttcccagattgtgaaagtaagggaagctcttggatagtcttaagcaagaaagtgatgggatcctttcctctagatgcaaggccacaggggacctacagaacacgccctctccctgcctaccaaactctaatctatatgaagagccaagctcttgctcccgtgccctttgttttcctttgggataaattgctacttttcctgattataatgaatacatatgaattattttcaaaattgaaacaactcagggatgcttgtggttaaaagtagagagcatttgaaattgctctgcctggaggtgactgcaattaattttctgctgactgtggcaggcagaattttggcccctagatcctcactcctggggctcactcccacaaatacgtttcattacatggcaaaaaggactttacacatgcaattaaggttactgaccagttgagcttaagatagggcaattacgctggattatgcaggtggacctgatgtagccacttgagcccttaaaagtagtgagtagaaacagaaaaggaagtcgcagagatttgaagcatgaggcctcgacgggtcattgctggtttgaaggtgggggtgccgtgtgaaaaggaatgcaggcagtccgaagttcctcagaaaaaggacccagctgacggtgggtgaacaatggaaacctgagtcctacaaccacaagaaattttaaattctgccaacaacctgagtgagcctggaagtagattcttccccagagcctgcagaaaggaatgtatccgtgcctacatttttgtctcaaccttgtgagaccctaagcagagagcccagctaagccacgatattcctggccttctgagccatgaaaactgtgaattaataaatgagttttgctttaagacactaagttgatggtaatatggtatggcaatgataacaaatacagtgaccatcctttaatgcatctcttcttccatatatgcacacacgaacacaaatgcacccaatatatatgtgtgattaacatgtacattgggtttttgtgaacagttaaaacaatttgccttgcttcttcttaaccttcttcctccagtgtccctttttatcccctttaaccaatattagtaatttcagatttataattttctacctttctctttgatgacatatatccttatacctttgtgatattgtgatataacaaggaatacatgttttgtctcctgtctccagttcctgtaatagagctcctaaaacccttgtaatttcctgagcaataggagtgtacagaacatctcttgttctaatatttgatctctgatccccatttctgacacagagcctgaattttctgggtaataaaagtgtcttttgttccaatgaggcaacttttggtggcctcctgcatggagctggtcaccagaaaagccaagccatggttagagggcttggaactttcagctccacttcctatcctcggggaaagggacacaagctagaaattgagttaataatagaccatacctgtgtggtgaagcctccataaaagtccctaaactatggggttcagaatgcttccaggtcgttgaacactcctatgagccaggagggtggcacacctcaactccatggggacagaagctccttcactcaggacccttccaggcctcaccctatgtatcccttcaagggctgttcatctatatccttcattatattcttcattatataataaactggtaaatgtaacaagtgttttcgtgagttccgtgagttctaacaaattatcaaagccaagagtcataggaaccctgaatgatagccagtcagttagaagtacaggtgaaaacctggggcttaagattggcatctggggtgggaggcagtcttgtgggactgcactcttaaagtgcgggatctatgctaactccagttagtgatagaattgaactgaattgtaggacatccagccggtgtctgcagataatagaaaaatgtgttaatgtgtgaaaaatcccctcatttggtggccagaactgtcctgtattgagtgtgtgtagtataagggagaaaatgcacaaactccaacacttagcacatcaattcacacacaacaggtattcaatcaatgtctgatgaataaatgatgaaattggcattatgtcatctatcagacatttattctctctacatccttgcaaagttaaggaaatccatgtgtatatcactcaattttgtagaaaaccagactgaaagagaaggcaaaagccaggatataatcatctttatactttgctattttagttttctggaaaccaactatttattggtgattatttttgctgattaccatgtaatcagccttagccctagccttagtcctaactataaccacaaccctaactctaaacacaaccccataacaagccctacactaaacctagccctaaaccctaaccctaaccctaaccctaaaccctaaaccagattctgaccctgacactgactcccaatgtgacctgtgaccagccttgactgatatcaactggtcttgactgactttgacaggctgtgacagggcatgacaggttctgaccagtctagaccagtcttgactgtctgggactgattataccagccatgactgcaattaactggtcttgactagccatgaccagctttcactggctgggaccagaattgaccatatttgactggctttgactgactgtgcccagctttgatcagtcttatctggttttgaccaggcttgacaagtctgaactggtcatgaccagcagtgaccagccttcactggctgtttctggcatgagcctgatgccttctgcctgactgagtgccaaggactcaggggctgtgcagcactgaggggtaggtgaaggggagcagagtgggagggaggaaagccctgtgggaatactcgaggagtgggtgtgcccaggagagctcactggttggtttataccataaggtccttgcgaatcattttcttgcagatagggaaataggtcctggggatgtgtaccaaactgtcagggcagaggacaggggcagggatgcctgcctgtcaatcaaaaagtcagtctcaaggcaccattttgtactttgttgtccagccatgaaagtcactagttcataataaagagttctatctcttatgactttgggtttggacttgggcttcaagtgttattgtggtagccagggctcaggaaggctgcaactttgcaccatgtcctttaaggaacaaatcctatgcacagtgaaataaatataagagatgagtatttttgaggtaaatttacttgatatgaatttcaccatttccccattttaacctttttttttttcactttaagttccgggatatatgtgcagaatgtgcaggtttgttacataggtatacatgtatcatggtgatatgctgcacctatcaacccgtcatctaggttttaagccctgcatgcattagatatttgtgctaacgctctccctccccttgcccctcaccccccagcaggccctggtgtgtgttgttcccctccctgtgtccatgtgttctcattgttcaactcccacttatgagtgagaacatgcactgtttgattttctgttcctgtgttggtttgctgagaatgatggcttctatttttaagtacacaatttggtgaaatttaacaccttgacagtgttgtacagccacctgtctagttccggtgcatttttatcatctccaaagggaactcagtacccattatgaagtcctttcccatttccccctccttcagtccctggaagctactaatctactttctgactctatggatttgccgttctggacattccatataaattggctcatacactatgtgccttttgggtctggtttctttcacttaaggtgttttcaaggttcatccatgttataacatacatcagtacttcattcctgtgttctttctgattgaatacacttaacatttaccatttaaactatcttaattatacagtcctatggaattaaccacatttacagtggtcatgtaccatcactcccatccatctccagaacttttttcatcatccccaacaggaattgtgtgttcattaaacactaacttcctattcctctctcctccagccactggaaactacctctctactttatatcccagtgaactgattactctaggtagctcagataagcagaataatacaatatttgtccttctgtgtcttggttatttctctttgcataatgactcatgtttcatccatgctgcagtatgtgtcagaattccctttgtttttaaggcagaataatattatataccacattttgtttatctactcatccattggtgggcacttgtgttgcctccaacacaagtggaggcatttagttctttggagcatatgcccatgtaactgacaggtttgcataatacatctcactgaatcctggaccacctgggaaagttctcctttaaatgcctgtgttagagaaaaagaatgtaatgctatgacccaagtctatgacccaagtctatgacccaagatcacagggtgacagcaggggttagctgggatctgaactgaaatattgctgagctgttgtgtttgtccattttgtgttgtgttgacgtgggtaatttatcaaggaagaagctttatttggcttatggttttgcagattatacaaaaagcatgacgccagcatctctgtctggtgaggcctgtggaagcttttactcattgtggaaggcaaggggaaccagcgtgtctcatgaggagagagatagcaagagagtgggggaagatctgagactctttttaacaactagatctcttgtgaactcattgccatgcagagggcaccaagccattcaggagggatccacccccatgacccaaaccctcctgccaggggccacctccaacattggggatcacgtttcaacatgagatttggtgggggcaaatagccaaaccatattagttctcatcattttcatggtgtattattagtccttcttgatttaaagttccattgtgcggccagcatttcaattaacatttacatatatttgcatatgaatgagcatatttaatacataaggttttatttaccaagtgttccatattttatcttttatgatattcacaacgtttcatgttgtgcaggtgttcctgtttttttgttgttccactcctacctgaggaacagctaggttaactgctactttggagtaggtattttttttcttttttttatatgtatactataagttctgggatgcatgtgcagaacttgcaggtttgtgacataggtatacgtgtgccatggtggtttgctgcacccatcaaccagtcatatacattacatgtttctcctaaggctatcccttcccttgctccccacccctcgacaggccctggtgtgtgatgttccccttcctgtgcccatatgttctcattgttcaactcccacttatgaatgacaacatgcagtgtttggttttctgttcctgtgttagtttgctgagaatgatagcttccagcttcatccatgtccctgcaaaggacatgaactcattcttttatggcggcatagtattccatggtgtatatgtgccacattttctttatccagtctaacattagtgggcatttgggttggttccaagtctttgctattgtgaatagtgctgcaataaacatacatgtgcatgtgtcttcatagtagaatgatttataatcctttgggtatatacccagtaatgggattgctgggtcaaatggtatttctagttctagatccatgaggaattgccacgctgtcttccataatggttgaactaatttacactcaaaccaacagtgtaaaagcattcctatttctccacatcctctccagcatctgttgtttcctgactttttaatgatcgccattcttactggtgtgagatggtatctcattgcaattttgatttgcatttctctaatgacgagtgatgagcttttttcatatgtttgttggccgcataaatgtcttcttttgagaagtgtctgttcatatccttcacccactttttgatggggttgcttttttcttgtaactttgtttaagttccttgtagattctggatattagccccttgtcagatggatagattgcaaaaattttctcccattctgtaggttgcctgttcactctgatgatagtttcttttgctgtgcagaagctctttagtttaattagatcccgtttgtcaattttggcttttcttgcaattgcttaagtcttacatttaaatctttagtccatcttgagttaatttttgtataaggtgtaaggaaggggtccagtttcagttttctgcatatatggctagccagttttcccaacaacatttattaaatagggaatcctttccccatttcttgtttgtgtcagtttgtctaagatcagatggttgtagatgtgcggtattatttctgaggcctctcttctgttccattggtctatatatctgttttggtaccagtaccatactgttttggttactgtagtatagttgtagtatagtatacaagtagtgtagtatgccttgtagtatagtttgaagtcaggtagcgtgatgcctccagctttgctcttttggcttaggattgtcttggctatatgggctcttttttggttccatatgaactttaaagtagttttttataattctgtgaagaaagtcagtggtagcttgatgggaatagcactgaatctataaattactttgggcaatatggccattttcacgatgttgattcttcctattcatgagcatggactgtttttccatttatttgtgtcctctgttatatccttgagcagtggttcgtagttcttcttgaagaggtccttcacatcccttgtaagttgtattcctaggtattttattctatttgtagcaattgtgaatgggcatttactcatgattttgctctctgtttgtctattattggtatataggaatgctcgtgatttttgcacatggattttgtatcttgagatgttgctgaagttgtttatcagcttaaggagtttttgggctgagacaatggggttttctaaatatacaatcatgtcatctgcaaacagagataatttgacttcctctcttcctatttgaatacgctttatttctttctcttgcccgattgtcctggccagaacttccaaaactatgttgaataggggtggcaagagagggcatccttgtcttgtgctggttttcaaaaggaatgcttccagattttgcccatttagtatgatactggctgtgggttcgtcataaatagctcttattattttgagatatgtttcaccaatacctagtttactgagtgcttttagcatgaagggtgttgaattttattgaaggccttttctgcatctattgagataatcatgtggtttttgtcattggttctgtttatgtgatggattacgtttattgatttgcatgtgttgaaccagccttgcatcccagggatgaagctgacttgattgaggtggataagctttctaatatgctgctggaatcagtttgccagtattttattgaggatttttgcatcgatgttcaacagggatattggcctgaaattttccttttttgttgtgtctctgccaggttttgttatcaggatgatgctggcctcataaaatgagttagggaggactccctttttttctgttgtttggaatagtttcggaaggaatagtaccagctcctcttcgtaattctgctagaatttggctatgaatcatctggtcctgggctttttttggttggtaggctattaattagtgcctcaatttcagagcttgttattggtctattcagggattttactttttcttggtttagtcttgggaggtgtgtgtgtccaggaatttattcatttcttctagattttctagtttattagtttctagtttattagttattagattttctagtttattagaagtatttatactattttctgatggtagtttgtatttctgtggaatcaatggtgatctcccctttaacattttttattgtgtcttcttgattcttctctcttttcttctttattagtctggctagcagtctatctattttgttaatcttttcaaaaaactagctcctggattcattgatgttttgaagggttttttgagtctctgtctccttcagttctgctctgatcttagttattcttgtcttctgctagcttttgaatttgtttgctcttgcttctctagttcttttaattgtgatgttagggtgtcaatgttagatctttcctactttctcctgtgggcatttagagctataaatttccctctaaacactgctttagctgtgtcccagagattctggtactttgtgtctttgttctcattggtttcaaagaacttatttatttcagcattaatttcgttatttacccagtagtcattcaggagcaggttgttcagtttccatgaagttgtgtggttttgagtgaatttcttaatcctgaattctaatttgattgcactgtggtctgaaagactgtttattatgatttccgttcttttgcatttgctgaggagtgttttacttccaattatgtggtcaattttagaataagtgcgatgtggtgctgaaaagaatgtatattctggtgatttgggatggagagttctgtagatgtctattagttctgcttagtccagggatgagttcaagtactgaatatccctgttaattttctgtcttgttgatctctccaatattgacagtggggtgttaaagtctcccactattattgtctgggagtctaagtctctttgtaggtctctaagaacttgctttatgaatctgggtgctcctgtattgggtgcatatatatttaggatagttagctcttcttgttgaattgatccctttaccattatggaatgcccttcttttttttaatttttattttatttatttatttattttttattatactttaagttttagggtacatgtgcacaacatgcaggtttgttacatatgtatacatgtgccatgttggtgtgctgcacccattaactcgtcatttaacattaggtatatctcctaatgctatccctcccctctccccctaccccacaacaggccccggtgtgtgatgttccccttcctgtgtccatgtgttctcattgttcaattcccgcctacgagtgagaacatgcagtgtttggttttttgtccttgtgatagtttgctgagaatgatggtttccagcttcatctatgtccctacaaaggacatgaactcatcagtttttatggctgcgtagtattccatggtgtatatgtgccacattttcttaatccagtctatcattgtcagacatttggcttggttccaagtctttgatattgtgaatagtgctgcaataaacatatgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccatcaacagtgtaaaagtgttcctatttcttcacatcctctgcagcacctgttgtttcctgacattttaatgattgccattctaactggtgtgagatggtatctcattgtggttttgatttgcatttctctgatggccagtgatgatgagcattttttcatgtgtcttttggctgcatacatgtcttcttttgagaagtgtctgttcatatccttcacccactttttgatggggttgtttttttcttgtaaatttgtttgagttcattgtagattctggatattagccctttgtcagatgagtagattacaaaaattttttcccattctgtaggttgcctgttcactctgatgatagtttcttttgctgtgcagaagctctttagttgaattagatcccatttgtcaattttggcttttgttgccattgcttttggtgttttagacatgaagtccttgcccatgcctatgtcctgaatggtattgcccaggttttcttctagggtttttatggttttaggtctaacatttaagtctttaatccatcttgaattaatttttgtataaggtgtaagaaagggatccagtttcacctttctacatacggctagccagttttcccagcaccatttattaaatagggaatcctttccccatttcttgtttttgtcaggtttgtcaaagatcagatggttgtagatatgcgacattacttctgagggctctgttctgttccattggtctatatctctgttttggtaccagtaccatgctgttttggttactatagccttgtagtatagtttgaagtcaggtagcgtgatgcctccagctttgttcttttggcttaggattgacttggcaatgcatgctcttttttggttccatatgaactttaaagtagttttttccaattctgtgaagaaagtcattggtagcttgatggggatggcattgaatctataaattaccttgggcaatatggccattttcacgatatagattcttcccacccatgagcatggaatgttcttacatttctttgtatcctcttttatttcattgagcagtggtttgtagttctccttgaagaggtccttcacatcccttgtaagttggattcctaggtattttactctctttgaagcaattgtgaatgggagttcactcatgatttgactctctgtttgtctgttattggtgtataagaatgcttgtgatttttgcacattaattttgtatcctgagactttgctgaagttgcctatcagcttaaggagattttgggctgagacaatggggttttctagatatacaatcatgttatctggaaacagggacaatttgacttcctcgtttcctaattggataccctttatttccttctcctgcctgattgccctggtcagaacttccaatactatgttgaatagaatggtgagagacggcatccctgtcttgtgccagttttcaaagggaatgcttccagtttttgcccattcagtatgatattggctgtgggtttgtcataaatagctcttattattttgagatacatcccatcaatacctaatttattgagagtttttagcatgaagcgttgttgaattttgtcaaaggctttttctgcatctattgagctaatcatgtggttttgtatttggttctgtttatatgctggattacgcttattgatttgcatatgttgaacgaggcttacatcccagggatgaagcccacttgatcatggtggataagctttttgatgtgctgctggattcggtttgccagtattttatcgaggatttttgcatcgatattcatcagggatattggtctaaaattctctttttttgttgtgtctctgccaggctttggtatcaggatgatgctggcttcataaaatgagttagggaggattccctctttttctattgattggaatagtttcagaaggaatggtaccagttcctccttgtacctctggtagaattcggctgtgaatccatctggtcctggactttttttggttggtaagctattaattattgcctcaatttcagagcctgttattggtctattcagacgttcagtttcttcctggtttagtcttgggagggtgtatgcatcaaggaatttatcaatttcttctagattttctagtttatttgcgtagaggtgtttatagtattctctgatagtagtttgtatttctgtgggattggtggtgatatcgcctttataattttttattgcatctatttgattcttctctcttttcttctttattagtcttgctagcagtctatcaattttgttgatcttttcaaaaaccagctcctggattcattaattttttgaagggttttttgtgtctctatttccttccgttctgttctgatcttagttatttcttgccttctgctagcttttgaatgtgtttgctcttgcttctctagttcttttaattgtgatgttagggtgtcaattttatatctttcctgctttctcttgtgggcatttagtgctataaatttccctctacacactgctttgaatgtgtcctagagattctggtatgttgtgtccttgttctcgttggtttcaaagaacatctttatttctgctttcatttcattatgtacctagtagtcattcaggagcaggttgttcagtttccatgtacttgaggagttttgagtgagttccttaatcctgagttgtagtttgattgcactgtggtctgagagacagtttgttatagtttctgttcttttacatttgctgaggagtgctttacttccaactatgtggtcaattttggaataagtgcggtgtggtgctgagaagaatgtatattctgttgatttggggtggagagttctgtagatgtctattaggtccgcttggtgcagagctgagttcaattcctggatatccttgttaactttctgtctcgttgatctgtctaatgttgacagtggggtgttaaagtctcccattattattgtgtgggagtgtaaatctctttgtaggtcactaaggacttgctttatgaatttgggtgctcatgtattgggtgcatatatatttacgatagttagttgttcttgttgaattgatccctttaccattatgtaatggtcttctttgtctcttttgatctttgttggtttaaagtctgttttatcagagactaggattgcaactcctgtctttttttgttttctatttgctcggtagatcttcctccatccctttattttgagcctatgtgtgtctctgcacatgagacgggtttcctgaatacagcacactaatgggtcttgactctttatccaatttgccagtctgtgtcttttaattggagcatttagcccatttacatttaagtttaatattgttatgtgtgaatttgatcctgtcattttgatgttagctggttattttgctcgttagttgatgcagtttcttcctagccttgatggtctttacaatttggcatgtttttgcagtggctggtaccagttgttcctttccatgtttagtgcttccttcaggagctcttttagggcaggcctggtggtgacaaaatctctcagcatttgcttgtctgtaaaggattttatttctccttcacttatgaagcttactttggctggatatgaaattatggattgaaaattcttttctttaagaatgttgaatattggcccccactctcttctggcttgtagagtttctgctgagagatcagctgttagtctgatgggcttccctttgtgggtaacccgacctttctctctggctgcccttaacattttttccttcatttcaactttggtgaatgtgacaattatgtgtcttggagttgctcttctcgaggagtatctctgtggtgttctctgtatttcctgaatttgaatgttggcctgccttgctagtttgggaaagttctcctggataatatcctgcagagtgttttccaacttggttccattctcccggtcacattcaggtacaccaatcagacgtagatttggtcttttcatatagtcccatatttcttggaggctttgttcatttctttttattcttttttctctaaacttctcttctcacttcattacattcatttgctcttccatcactgatacccttccttccagttgattgaattggctactgaggcttgtgcattcgtcacgtaattctcgtgccttggttttcagctccatgaggtcctttaaggagttctctgcattggttattctagttagccattcatctaattttttttcaaggttttcaacttctttgctatgggttcgaacttcctcctttagctaagagtagtttgattttctcaagccttcttctctgaactcatcaaagtcagtcttcgtccagttttgttccgttgctggtgaggagctgtgttcctttgaaggaggagaggtgctctgatttttagagtttccagtttttctgctctgttttttccccatctttgtggttttatctaccttttgtctttgatgatggtgacgtacagatggggttttggtgtggatgtcctttctgtttgttaattttccttctaacagtcaggaccctcagctgcaggtctgttggagtttgctggaggtccactccagaccctatttgcctgggtatcagcagtggaggctgcagaaccgcggatattggtgagcagcaaatgttgctgcctgattgttcctctggaagttttgtctcagaggagtacccggccgtgtgagttgtcagactgcccctactggggggtgcctcccagttaggctactcgggtgtcagggacccacttgtggaggcagtctgtctgttctcagatctctagctgcgtgctgggagaaccactactctcttcaaagctgtcagacaggaacatttaagtctgcagaggattctgctgccttttgtatggctatgccctgcccccagaggtggagtctacagaggcaggcaggcctccttgagctgtggtgggttacacccagttaaagcttcccggctgctttgtttacctactcaagcctcggcaatggcgggcgcccctaccccagccttgctgccaccttgcagattgatctcagactgctgtgctagcaatgagcgaggctccgtgggcgtaggaccctccaagccaggtgagggatataatctcctggtgtgccatttgctaagaccattggaaaagcgcagtattagggtgggagtgacctgattttccaggtgccgtctgtcacccctttctttgactaagaaagggaatttcctgaccgcttgggcttcctgggtgaggcaatgcctcgccctgcttcggctgatgcttggtgtgctgtacccactgtcctgcacccactttctgacactccccagtgagatgaacccagtacctcagttggaaattcagaaatcacctgtcttctgtgtcgctcatgctgggagctatagactgaagctgttcctatttggccatcttggctctcctctacggaatgcccttctgtgtctcttttgatctttgttggtttaaagtctgttttatcagagactaggattgcaacccctgcttttttttcctttccatttgcttggaaaatcttcctccatccctttattttgaacctatgtgtttctttgcacatgagattggtctcctgaatacagcacaccaatggcttttgatacctatccaatttgccagtctgtgccttttaattggggcatttagcccgtttagatttcaggttaatattgttatgtgtgaatttgatcctgtcattatgatgctagctggttattttgcccattagttgatgcagtttcttcatagtgtcaatggtctttacattttgggatgtttttgcagtggctggtactgatttttcctttccatatttagtgcttccttcaggagctccttcaggagctcttgtaaggttggcctggtggtgacaaaatccttcagcatttggttgtctgtaaaggattttatttctccttcacttatgaagcttagtttggctggatatgaatttctgggttgaaaattcttttctttaagaatgttgaatattggcccaaactctcttcaggcttgtagagtttctgcagggagatctgctgttagtctgatgggcttccctttgtgggtaacccgacctttctctctggctgcccttaacattttttccttcatttcaatcttggtgaatgtgacaattatgtgtcttggggttgctcttcttgaggggtatctttgtggtgttctctgcattttccgaatttgaatgttggcctgtcttgctaggttggggaggttctcttggataatatcctaagcatcttttccaacttggttccattctccccatcactttcaggtacaccaatcaaacataagttttgtctgttcacatagtcccatatttcttggaggctttgtttgttcctcttcattcttttttctctaatcttgtcttcacactttatttcgttaagttgatcttcaatttctgatatcctttcttccacttgatcaatttggttattgatacttgtgtgaccttcacgaagttctcgtgctgtgtttttcagctccatcaggtcatttatgttcttctctaaactggttattctagttagcaattcctctacccttttatcaaggttcttagcttccttgcattgggttagaacatgctcctttagcttggaagagtttgttattacccaacttctgaagcccacttctgttaatttgtcaaactcattctctgtccagtttttttcccttgctggcaaggagttatcctctggaggagaagaagctttctggtttttggcattttcagcctttttgcactggtttttcctcatcttcgtggatttacctttggtctttgctgttggtgacctttggaccaaggttttgcttggttgtccttttttttttcatgttgatgctattgctttctgtttgttagtttttcttctaagagtcaggcccctcttctgcaggctgcaggtctgctggagtttgctgggggtccactccagacgctgtttgcctgagtatcaccagcggaggctgcagaacagtaaagattgctgcctgctccttcctctggaagctttgtcccagacgggcacccgccatatgccaggaggagctttcctgtatgaggtgtcttttgacccctgctcggaggtgtctcccagtcaggaggctcgagggtcagggatgtacttgaggaggcagtctgacccttagcagagctcaggtgctgtgctgggagatctgctgctctcttcagagctggcaggcaggaacatttaagtctctaaagctgcgcccatagccaccccttccccaggtgctctgtcccagggagatgggaattttatctacaagtccctgactggggctgctgcctttctttcagagatttcaggaggaatctagacaggcagtcggactacagtggctttgtggtgctgtggcaggctccacccagtctgaacttcctggtggctttgtttacaccatgaggggaaaaccacctactcaagcctcagtaatggcggatgccccttccaccaccaagctggagcctcccaggtcgacttcagactgctgtgctggcagggagaatttcaagccagtggatcttagcttgctgggctccgtgggcagagcggaatctgctgagtaaggccacttggatccctggcttcagccccctttccagggaagtgaatggttctttctcgctggcattccaggcgccactggggtacgaagaaaactcctgcagctagcttggtgtctgcccaaatagctgcccagttttgtgcttgaaacccagggcccttgtggtgtaggcaaccaagagaatctcatggtctgtgggttgtgaagaccgtgggaaaagcatagtatatgggcaggatagcactgttgctcactgcacagtccctcccggcttgccttggctaggggagggagttccccgaccccttgcacttcccaggtgaggcaacacttcaccgtgcttctgcttgccctctgtgggctgcacccactgtctaaccagtcccaatgagatgaacagggtagctcagttggaaatggagaaatcacctgccttctgcattggtcttgctgggagctgcagactggagctagtcctatttggccatcttgctcgagaatccctggagcaggttttcttggatgagaaaagaaaatgcttggcgtgatattgcaggggtgaagagaagaatcagactctcagttaatcttgcctagatctggccaatgtttgtggtaatacatttttatttccttcaatatgatattatggactatgggagctttcttgctggactagtctccagtgaaagtgggacagtttgttccaaagtctccatggcatctgggccctaacccatcatttaatttagtttagcaaaactctaagggtgtggttactaaaaagcattgaaaaaaacctaagtaaacatatcataaacttttcttgtggagagttcatttataaacttttatctcatttacatctattttattcatttaacaattatgtttaggcagttttaggagacattagaaaaacctagtcatcatcacaagtgaaattttctattagccgtttctatattagtgtatgttaggcaagtatcatgaaagcaagaaccttaaagttaagtacatgtatattttcttgttagctcagaagacatagttatttttgttgaaccaacaataacaatatagttttatttaccaaaagatttattcaagtcacataaagttgaaaaaacatttggtcttattcatttaacttatgagtactcattcaagttattgtggtaccatgtgtagataatatgtaaagatatgtatgaccatatacatatatgtagacacaacatataacattcacatgtgcacatgtatgtacctaatagccaaagagatcaaggagtttagtgcaaaagagagtagagcttcagacttgaatctgtccacttacaattcttggggttccatgaggataaacaaagtttcctccccaaaagagaagcccatgttgccttttctgtttcccttaagagatcccaggcagttagaattgtttttaggttccctcctatggcattgaaagtggcaaggggaaggagggacacacagaatagatggagaggcagacagagggagcaaatatggttagcagaggtttaagaagacaggaattcagttgattgataagttttacagagagaaaatagaggccttaaacaatatgtatgtataaatacatagcctaaatatcagttttaattaagttaacttttgactatggagctcttaaaaaatcttttaaaatctcttgttaacagatcttagctggaatttctgagttctgatttttttttttttttgcaacaggtgtaccctcccaaatgaaagcaataagccttgaccaaggttgtgacttaaccaaggattcacaagacatctccaaacatgtaagtgggtacctccgaaattaagtcacacaaataaatgaatagggactggttccctgagcagaaatcacacccaggccatggctatgaaagtgtgaaattggaactaccggacaacaggtggagcaacattcattttaatcctgcggggaatctaaagcaggcaatttgagctgacaaagattttaaattaggttagatttttgctcttaattatgtcaagaggatttctagggctggccatgacactattgcatgtctttctttgaatttgatcttcccattaattgtttagaatgagagatctcaaaggtcttttttaaaaaaatgtaggaatctaatttaaaagattcaccttctggccattgaatttccaatggcatacttatttcaatagtgacttaatccaaaagcctcttcatggaaagcccaggtttaaaaaaagatgtttcctggagacggcacaagagaagcaaacccaaagactcccaccctgaaaaactctcccagtaataggttcagatagcaaaggactcttgttactacagattgttgagaatggtgtatgcctttggcaacccagaatttgtgagggaggatgccactcacagaccttttaatctgtgaaacctcataggcctgcctagacttgcactttctcagcactaaccaggcaacaagcattgagatggcaaaagtggtgtagaaatggaacttcttaagacaaactctcctgagagcttgacatatttggaacaaaacgtctcaattttgcagcctttttgagactggctacccaacgtgacttgaaaatcacactgcccagatggcagataccaaaagagagtccttccacttggtcacaagttaagctttcaaggacatcaaacaagatgagagagaacctaaaatgatacccctctttatgacagaaggacacacaaagacaaagacaaaggaaaatactctttctgggagaaaagggatcaaacattatgaatattcaaaccacaaagtaccaaaaagtatatcaaagtcattggaccaagactagtcaaacaaatcctttcctcccattaatcaagattttggaaaagaaaaagaaataaacaacaatattgactgtctgcttaaccagattccacagagagacagaggcctggagcctgactggtaagaaatccttacccttttgatagctcatcgggacctggattcacttggctgtgggtttcaggagagcagagcctgctcacagcgtcaagctgtaggagccaagggaaagtgtcccctttgccctcggaaggttcgctaaaaaatcagctcacaatggcagattgattgcagcaaaggcatagaaactttattgatgtgtacacgggggcatcacagaggttacagaaaaaacgtgggtttagggaatggccacaaacaggttatagtggtaaaacaggttatagtggcaagacaggttatgggagagagagaaaaggaggcctggatagcaggggtggtctggttatgtagaagaaccctcacagttagcagccctcagagaaaatagatggtaagtgttgctttccaatctttaaggtgtcagaatcttagttcctctttcttaggacccaaggagggaaggcttggcttagtttatgcaaattgcttacacatgcaaattttccccacaaaagtcaggtttgcagggctacctcttcttgctggctctgtttatataatctccaattatgtcaaggaaatatattttgggctttttttttccttccttatgatattctaaattatgggaactttcctgctgaactagagtttctggggaaggtccatggggccaagaatttgccatcccacagggggtgacagagccggccatttggttcattgagatgaggcgcaattttagtgttggatgtgtacttgccctaagtcctgtaacaaagctttgacataataatcacacctcctcactgcatttcaatatccataaatattaataagtcttctgaacgattatctgtttcctgtactaattgttcactgtataaaaaagctgttttgaatatttatatagattgtcaggatgtggactgggactttttgtcaattaactatactgactgattatgtaaacatcagtgtgtgaacctgaaatatcttgcaacttgtctgtgtacatgcacatatacatatatatatacacacacatatatacatacatacagataagaatatagcaaggcaataagctatccatttaattattatgaaattttaatgataaattttgtttcaattaggctttcacttagcattgagatttcatttttctccactaattatcctaaatatggactctgtatttagctactattttcttgatttagaaattgagggttattctcacagatgatttgccaaataacattttttttgtcttttgaagaatgatgttatgaaatttgcataatatgaaattacatgacctttaaggatttagctgtacaaaatcttagaaaatgtgataagtgtgggctttgggtgaatgggttgagagaatgtgtatgcaatcccccagacaccctagagtctgctgtgtccccaagagagcagactagatggcaggcaactggggtggaccggaagggagagggcagcaggcaggagcactcattgtctggaggccatggtcagcactgtggtccttgttctaaggccagtgggaaaccattggcaaagttaagtcaggagagtgacatgacaaaatttgtgtttgtaaaggagtatttaaccactatcaggttgaaatcaccagaggtgggtgggtgggtctgtgctgctcctggtgggctacactgaggagaagcacagcatcagcccggggtgttcctgtggtgaatgatgggtctgcatctgcccaggagaagacagtgggaagctccagcttggagtcacctctgctctttagatctgccaaagttgtgaaatgactggacagtcccaagaacagctcgagaaaaagctggatctgaataaaaagggacatttgtctctcggtccaggcagtgactgaagtggatctgaagattggattatgtaactgagataggccccaagaagattttcatcttactggggaaagggcctacaagacagcgagaaaaatctctgctaaattgattaaatccattccaatgctccttccagaaaaaaattgactggaaggctatacagtgatgcattcagaaagaaagtgagtctgtgttgtgactactttgactgatttttaaaaactttccaacaagactatggtatcaaagatctaactgatgataccataaatcattttaattcacttatcctttcaggtctcaatgaagcccttagtgctttagctaaacaacataatccctgctaagcttcaaagagacccatgaaaagcttccctggctgaatgcctctcaaaaaccatgcaaaaagaaaaagaggctaaagcagaaatgaggaaaaagactgctaaacttgtggccttatatattcaacaactcaaagcctcaaatcagcaagccccacaaaatagacagaaagcagtagccttgtctactttaaagggcatgatttgctttgcctgtaagggtcctggctatataaaattatattgggaaaagtacaaacaatggcttcagaagtactcaagtaaggcaaggaatccctcttactcgcgagaacttgtaagagaagtttttgttgggtaaaactgaggactttctgggggaaattagggggatttttttcctttcctttcagttaattaagtaggagaagctggtcttaaaatcaacagcaaattaatctgagctctagtggacactggagctctgctcttggtgcttaccctcaactccttttcagaccccccctccttagagtaatcaaacaattgaaatagtgagggttgctaaccaaactatgaccgtctttaagtctgagccagtttcttatcaattagggccccttgccggccaacacagtttgttgttgtcctctctgccccaatccacttgatagtgaaagataatctgaaaaacaccaagcccacatttctttcacccacaagggagatatcatcttagaagtctccccaaccaaggtttcagcctctagtgtcactcgcatcttctccctgctagtttctagctatgtagttgtcactgaacacccagttctatagcaactgcctgaaaccctttgggtgaaagcggatacagatgttggcctgacccattcagcatcacttatttctatacagatagacactaacagccctcttccaattttaaaacaatgtcccctcaattctgaagcttgagctgatatagaatctatagtcggttgtttcatttcccagggactcatagtcctctacaccagtccctgtaatacatccgttctgccagtctgtaagcctaatgtgaatgaatgaagatgcatccaggatcttagagctatccacaacattgtctgtccctgacaccctgttgtacttgatccacaaccactcttacccaagattcctcctgacactcactgtttctccactgttgatctctgcagcgccttcttcagtcctcctgtcagccccaaaagtcagtttctttttgcctttgcttggaaaggctaacaatttacatagatgatgctttcccaaggatacaccaaaagcccttcccacctttccaagattctgcaggctgacctaaaagaaataaccttcccagataatttgactccattacaatatattgatgtcttgcttttatgctccctctctcaaaaggcttgccacactgacactcgcctcttacttcaccagctagcccttaaggcacacaaggctctaagacaaattatatttttgctgggactccatcaagttccttgggcatcaggagtaaacattgacttcacctgctttcaaggcatatattcttttcccttgcccaatgctaaaagataactgaggggtttctggggacttgtggtctgccatagagcttggatccctaatttctctttgatgacacaaccttgatatacttcgcctgaggcttctccccagactccttcacttgtactaccaatggccaaaagcctttaagaatctcaagcatcagctgtccttgcctctcatgttgggacaccttaattatgaccttcctgtttcccttctcattcttgaatgaggggggcctgtgactaatacctggtccagctgacaggcagaataacatgcacttaccccagcttgcctgttagccagagataaaactgcagacatttgcacagacagcagatacgctgttggggttatccatgactttggaaacagaaaatttctgacctcttctagacagcctaccaaaaataaggatcatgttttggcacttcttgatgccattctggctcttagagccctgtctactattgaaatccaaggtcactcctctgagaatatagtagaaagatagtaggggcaaccacctgctgatgctacaggcaagactgcagccctaaatggtaccacttctgttatccctgtttccattcaaaccctacccttacccattgctccttccaaaaaacttttctccagactctcttggtctcaaaagatgtccgcagatggcaaaaaaggaaaaatgggcaaaacagggttatacttacaaatcataatcccagttatggaaaggacttaactttcatcctgtccttccagaaaatttacaaaatttacaaaaagccacccttgcctttaaacataacctcacccattggagcccttacaaaataatccagtggggaaaacagtacaattggggtcctttcctgatggttgcttctcaagtctataaatgatgcagaatctgttatttgtataatgctgggaagcccccaaaggctgcctccagagaattcccattaccaaatggcccttttgcaaactagtacccctcctcacttggatgcaagtatgtacttgagatgatagatatgtactcccattcggtagaggcctttccttgcagacaagctatggccatgatattagccaaaattctttttgagagaattatccccacttggggagttcccactgaactccacagtgattgtggaccccagtttactagccaagtattagaaagagtttatgatgtctgaccttttctgcaacacttccattgtgtccaccacctacagtcttctgggcttgtagaatgaatcattgggataataaagagcccattgcctgagattacaaacactcttaatctgccctggcctagggctctccctctagctctgttgatcctgctacctaccctctctggaaaacaccacctctcccttttgagattgtcagcaggccagtccatgcatttacctgagggaatgttttaccctactgttacaaggagacctcctgacttactgccaaggacttgttaaggcttcaacgactaaccataaactggttgtggaatccttctacagtagcccatcaaaagatgaaatctgataccatgacctctagctaggagacttcatttactagaaaagatgccagctaaaagatttcttcgagccttgcagaaaaggcccattcctggtactcctgactaaaccatgtgttggtaagctacgggtcattgactgctggatccacatatcccacctacaaaaggcacttgcagatgtctgcaattcagccccaatacctgataccaaatgtaaggtggctggagccccaacaccaggatgagaagaagcccatcattgagggaaactgcttcccccaagactctggaccagacctgaatccagatgaaagcttacactcccttcacagtggttatcacactcattgctttaggagttttcagagttgttactagcttatgtaaaacaagacacatagctttgctttgcttatttaaacctaatatgcccagtcattttgcatacttcataattctgttaatgatagaaatgtaggaatcttatgtatagcagacattttatgtcatatgaaaggaattccatgtattcgtatatttagatacctgtaaaccttccttgcccaaccccattcacggtccctaaatctctttcctctagaacacatgatccccactccagaaggcattgcccctcggcctcttgtcagccggacactttactacccttttagaagggcaataatcctaccaaattaaggctccacccttacaacctcatttaaccttaattaccttcttctgggccctacctccaagtcactttgggggttagggcttcaacttataaatgctggggagacacaattcagtccatagcaaacagtgatggaacaccatgtgtgttcccctcacacatgcagctcttcactacttctcactacagcatatttgagtgcctactttaaacacagagtgaattacctgcctcagcctgacttatgtttgctgctggccatagcacgggcaccagttgtaccactggcaatggccctggcccctgcacactccatggcattagttcccctattccctgaaatcctggcttggactttgtcctgatcttctctcaggacctctttgcacactgacctgtaggaccagaagtcaacgtgaataatcttgtctgcaaaccccaaaatgtacacggttttgggttcagtgtggtcatgagggccccacaggaatttgtagcatataggatccctgttgggcatctgcctcaaattcagatattgttgcgcaaaacatcttcaatgaaaagctttctgggcctttcaaaaatgatgtgcttcctctcagcatcttcacctctctcagcatattccagatgtcctcttcaggagcaaagttgccctccatgaaaactaggtctagaataacagtttggagcaagccccagtctttactcactcagtctctcagcagaggaaagttccactttgttgatgaggatgtcacattgcttcctggcatccatgttcacttcctcaactcaaggccaaagagtactccaggctctcagaggctttgctgagggcctcacggaaatgatccatgtgctgttggatgatgtgcttcagcatttctgccttttgggtgggctccttcttctggttctcgagcaggaggaacacctccaactcagccacattactgctcaagaggtccctgggcctgaagtcagcaagtggtggggcctatggggcatgtggcccttgcttttccttgtggctgcttgctccctcacctgagctgttccctgagggaagtaaggtggcagtggaggtgaaacggggattccaaggacatggaggagcaatgagtgtcccaccagcaggtttccccttagcggcctgtgatctgataacaggagaatggggagaaggcctcctcctcagcctcaagagcctggttctcaccttaggcctggcagtgtgaggggcctcagcaagaaatctctcccatggattggaggaaggctgtctctgccatttgtactttagaatactgacccagactttgatccttctcatcactctattccctgagaccctaggagatacagtgaactagctcctcagtagcaagcagtcattctctgggcttcccagctttgacagaggagcatcagatggtggcacattcagcctgtattcaggggtcatcgccttggcggttggaagggcatgtcctgctcaatctgaggctgcccccgtcaaaccaccacagtctccaccctcaatagagaaaactcaattttacccttcaaccgaaaacccccaaataccggcagtagaattaggagagaacttgaaaccatctctctctacttcctgtggaggtgtgggaatatctaggaggactgaggtggatttatccttctggggtgcacctcaatctcatggatcgaggctacctaaagctctcatactcctggacactgagactgtacttggtaggatctgtggaacacctgagctctattcctgggctctgaaggtgctcacagtgagaaatgccctgcatacattgttggcctataccctgagacctgagaccccaggaggagttggggggatgcctcaggttcaacgaagccattcccaggagctgatggggatcagcagggatgggactccatggggtccactgtgtgatggggtgaacaatccccttggttctcactcagggtcttcactttgactccaggcagggcctgcactccctgccatctgctgacctgaggactgtcccctcagactaaggctctcacttcctgtatatctctgaggagacagtgaaggtagaggactcccagagtgaacagcaggggccagatcatgctggttctcttctactctggggtggtggtcccctcaatcctcaataagggttcttacctcaactcaaggcagggcctaagctccatccaatctgctgacctaagaacaactccttcaaaccaagccttcaactccatgagagtccagaaaaggaagcgacaggggtctcagctaaacagctctgatcagggcctcctagggctgaggccagggctggagttgtgcagagaaccctctggtcaggcatgtgtggcccccttagttcttctattgtaccttgtggtaaaagattacattgtccacggaaatgcctagagaaaaatccttgcccagagagaggtctggctgtggttcctgggacgcagtctctaagcccttgggatgtcttgcctgatcatggtgtccatgtttatctggaaaccttaggccgtgctggataggctgtgctgaaaatgacttatgatggcagccttgggtcacatggtagtagctcgacctccagaggggctaacgactgaggttagtcaaatgggttttcaaccatatcgacctaactgagcctcaataaaaacaatgggcacaaaggctcaggtgagcttctggagttagcaatactccatgtgtactgtcatacctagaagttagtgctgtctgggactcaacacagagaggaacgctggaagctctgtgcctggaactccctgggctctgccctgtgtgcctcttctcctggctgattttaatctgtatcctttcactgtaataatccataaccatgagtatgccagctttctgtgagttctgtgagtccttctagcacattatcaaacctgaggtggggcttggggacacccgaatttgcagttggtgtcagatgtgagggtggtcttgggggctgctgaactttgcaggtctccaccttgactcctggtaggatctgagattccttcctctgttgacctgatgcctttgctgtcaggccccaccgcagagaaaacaccgaggaggaagtgatcatgcctgtcttccagtaacctctaccctgggcctctgagagcagatagcacaggtgagggtctctgcaccttctggtttgcttggtctcctccatcctccctcagactcctcagctagacttctaggaggacctgggtctcctctttctgctcacttgaggccaaccccttagatccagtctgagccacacagagagcctctttaggagaaagccagtggaggcctcagtgagatagccctactgggggccttgcatggctgaccacagaagtcagattttgtgggaccccctctgttctggggtgggttgtgtctttcatcttcatccagggtctgtgccttgatacctggcagggaatgggtggcctcccttctgctgaactgagtcctccaccaccacttacccaaggcctcaccatcctgagacacctgcagggaagcaaggaaacatttcatcttgttagccctgcccgggctttccagagccaacagcaggggtgggactctagcatcctctctgctccagagcgactgatcccctgaatactcactcggggtcctcaccgtgattcctggaatggaatagactttctcttttctactaatctgagtcctgacccctcagaccatggctctcacctccaggagacctctgttggggaagttgaggaatctcatcctgcttggggtctccaggggatgacagcaggggccagccagactccagggcccactctatctggctttagtacaacatgggtcctcatgctgtggtcaaccccttggctgcaatcagggcctgggatccattgctgatctgaggcttctgctccgaaaaccaacacccttacctcccagtctcctgaggaggagtgaggatgcactgccagagtcagttggcctccccttcctgggatcttccagggctgacagcagggctggtggtgacggagctctatagagcctcatttgttctgaaggtaagaaagttttctgcaggaatgagttctgctgcttctccagaatgcagtcagacttgttctatctcttttcctttcccttcctctatagcatgtgtgtgtgtgtgacattttcatgtatacggggattgatttctggacctgctatacttttccattaatcagtttatcagttcctaatccagaaccacactgcttaactgttaactgttgcattaactttgctatcacttaagccaattccctgttcattatctgcttttcttcagtccggtcttggcttttttttttttttttgaggcagagtctcactctgtcgcccaggctggagttcagtggcatgatctcggctcagtgcaacctccacctcctgggttcaagcgattcttctgcctcagcctcccgagtagctgggcctacaggtgtgcaccaccacacccagctaatttttgtatttttagtagagatggggttttaccatgtttgtcaggctggtctcgaactcccgacctcaggtgatctgcccgccttggcctcccaaagtgctgggattacaggcatgagccactgcgcctggccggtcttggttttatagctgtacatagctgtgtatttatttgtccaggtcacttttaagttcaattataatcctaaacatgttctcatatctcatgcaggttttattagaatatgacatatttataagttcagaattttcttggccttcgttaaagtttttcattttcatttgtttaacaatggaaccattttacctatgtttatttgtagatatattattatttaaaattactgtttggaatgcactcatttttttactctattctaatttgtgataggtggcatatagaaaaccataaacttttgtatagttatttgatataattcccactcaataaactcttgatatttttccattgattctcctacattttatttctcttggtggatgatgaaattttctgaaaatggtgataaaattttgctctcctattcattattcgtatctattctttttgttcctttcttagtgaattgtgtaggatctgcagtaaagtcttgaccaaagtggtgatatcaggcatctaggttgcttgcctttgttggaattatcctggtgtttcactatctaatacattgttgccttttaattcttatgcctatcaagttaaacatgctttgttttgttcctaatttacataagatagtcgtttaaaaagtcattttaaaaattcaacattcgatcttaatgacatttctcattcttattaatgagaaatgtcattaagatcgaatgttgaatttttaaaatgactttttttttgtcattgatccaagtggcattcccccccgccccatcttcacccaaaggcatgggtctggtgtttctgcacatcttctgaacaaatggcatttacagctttgtttgaggatatttgcaaagctgttccaggtcaggaattgtatttgcttacattccagtgtaataatgcttgagtctcctccccaacccagagacatttcaaggagataatgtcactctctcagtcaaagggcagatttgtttccaaaccagaataataatgataatggcttcctccagggcaacattgggtcaggtttgctagcagtgcccttataagattgggcgatttctaagttcagaattcctcagcagtgacacagaccaccaggtaggacttggggaaccacagcaattgatgtaaacatgaagctcatgtggcctgccatgtaatgcataaaaaagtgtccaaatccatttgaactcattgtctccttactctccgtacttacggaaatgtgctaagccagcctaatggctccttgagtacttgactcaaatatttatagatgttagaattttggggtgaagaacaattttgtggaatctgtcagcgataaaccacttaagaaagatgaagaaagagagttatatgaaaatcagagctcggtacttttcactttttggaaaatgaaatgaaatattgaggcaggatgaacatatttagcaataaaataattttttgttgtttttcttccaacttttattttatatttgggggtactcatgcaggtttgttacacaggtatactgtgggctgctgaggttttagatgtgattaaacttgtcactcagatagtgagcatagttcccaatgggtagttttccaccctttcccctctcccaccctccccattcttccagtctttagtgtctatcgtttccatttatgttcatgtgcacccaatgttaagctccaacttgtaaatgaaaacaagtgataattggtttcttgttcctgcgttagtttgctaaggggaatggcctccagctgcatccatgttgctgcaaaggacatgatttcattcttttttatggctgtgttgtattccatggtgtttatgtactacattttctttatccagtccaccattgatgagcatttaggttgatttcatgtctttgctgttgtgaatagtgctgcgacattttctttatccagtccaccactgatgagcatttaggttgatttcatgtctttgctgttgtgaatagcgctgtgatgaacaacatatgggtgcatgtgtctttttggtagaatgattcgttttcctttgggtatatcctcagtaatggaactgttgggtcaaaagatagttctatttgtagttctttgagaatgaaagcaattttagaaactgctgcaggcaactggaaggaataaaaccagttcaacagccacttgatatgctgtgcaaaagtggtggacatgttggggatgtgaggcaaagaatggaggactgccttcagtgcaaggagcagttcaggttatgatatgactcctggttcacatattttccatgtttcagggcaagaaacttccaatgtatatctccacctctgaggccacactgtaaatcctgttcatagcctgggaaacatagcaaaacctctgagagatgggaggattgcttgagcctgggaggttgaggctgcagtaagccatgatcacgccactgcaccccagcctggggaacagagagagaccctgtctcaaaaaaaaaaaaagatagccctgttcagttcccaggtggaggaagatttccaaatactggaggataacaaccttccaggggacagttgtcctcactctctcctccctggaatttgttcatattcacacccttcatccattttcagagaacagctgacatcagcaaggaaagtttgtttctgccttctctcagttcatagtcctcatagagtgggtcttgacccatgccacacattgcccactcccaaaagcaggatttgcaaaacaacttgggtagcgggatatgggtagaagggtaggaaaaggatgaggaggagggataaagtcagcaagtgccttgaggactgcactcctgtcatgttgttatcacctggcacttttacaagctcaggatcagctagtttcctgaacccactcagggatgctgaggtagctctcctaccactccctcagaaggacagcgcttcctcacttccacagatggcctaagacatcacagacagtgaatggcattaagcagtgtgtgtgtcatgagggattaacatctcagggttcagctgcaaacctgacctagtggagtgccccagggaacacaggagtgccccaggcagctcaaggttaacctcaaggtaatctcagactcccagaatccttacagcaagtcattctgaacactcagggcccaacctgcttgagccattcgctcatgtgaaggacaacaggacagatggaggttcctatgtggatgaagaacaggagcagttctctaggcaggctggtgggagacgaggatgtgttcagaaagaggaatgtctaattagagacttctagcccacatcttttcaagtgagtgaacttgaaacatctgtagatgatgggagaggcacaagggattacctgagtcctgtgaggagagctctgaaggtcgggtgctttgacacaagaccattggattgactgagcagtgtggcttggaaagatcaaatgttcaaatggccttgcctggagccacagacacttcacttcagtagaaataataaatatggggtttatatggctttttctcatttagtttttctttcagcattgttttaaagcaattcacatttaatcttggaaagttgacaaaatatagaagagtcttaagcaggcaacttgttgaaaaggagagcagcacaagctgctcaatgtaactgtgaggtggtttatttatccactccacttttgatggacaattgagttattgccagcttatgaccattatgaataatgctgctatgaatacccctttacatgtcctttcctgaacatacaccctcattgctgttgggtatatacccaggagttgaattgctgagtcataggatatgcatttgctcagctttaagagttacaggggaaaggttttctcacgtggttgtaccagcttctacttcactagccatatgagaaagtcctgagtgctctacattttctccaaaatgagctgtttttcttcaatgttattttagccattctggtgtttgtgtaatggtttcacactgtgaaaattgtgtaatgtggtttgacattgtgaatgtttgtgtaattgtttcatattgtggttttatttcacagttccctaatgattaatgaatcaatgattagtaccttttcatatgatgaattgatgacagtgtcttttcatatcgctaatgattaatgattaatgattagtgtttttatatgtttactgtctatttcataatgtcagaatttagtgttaaattcagaatgccactggattcaccatcttcactataaaccctggaactgacacaagaccaacatagccccagtaacagccaccctgatatgctcagagacaaactattgtctaatgcccttcccacattagtattcaagttgctacaagtaaggtagttaggttgcccaaataccaaatcagctcattagagagccatacctctactcatttattactcacccttctataactgtggggcacccaatgtcccaattctggaccctacttttacccaaacagcactttttatcccctgttttgcctcaaccctatcccaccatgcacactgaagtttcgtggcctacatatcctattgtgtctgctgtatccattgattgtctgaagacaagtcccccttcctagacctccacctggccccttttgtccaaggctgagagtacccatttccattccctaaactactccgtggctctctgccatcactctttaagtatcttaaaagctctcacgccacctgcactagacagcccatgactgaacttggtccatggttctttgagtccagtatccacataaaaacagtaagctgttgtttctagatattttattggcataattcttttatccacctgaataatttctttaaaaaatggtagcaatcattttactctgcataatccctagtctatgaagactaggatggcagaggagctgtaattgagcagggggctgtgagcctaggctctggcccactcagcacctcttcttccttctcagcatagggagcttggacactcacccccacaatcctagggcttccttataaactccttgcaaagccctctgtcaggagagccttcctcagatgcaggcctccccatcgtgtttctacacaggcatctgtctgcacagactgcaattttgtgcttggctttcaagcactgtcaaacacttatgccttccccacctcaacccaactatatctcacaatcatttttcttgttttgtcaacttatctatccttaaccattgcttcctatatacacacaggtacacactctgcactagaccactcatctctcctgctctcaacaggcaggttgcggaccccctgccattccatgcatttccccattctgctcgggattgttcacaggccctggctttcaactcttcccaaagccatgtctccaccctccttcctggcccagctccagactgtcctctaggaaagggatctttgttactgcccttacctggaagcttctcagcatcttacaacacaaggagttctctgtctcaacacatttgctttcctagcttcaaaacctttctcaggttagggtcttcctggtaggtggattttattcctttatcaatcagactatccacatgagtagggggcttggtgcctcttacttccatgtttttgccttcctgatatcatatacaatctccagttgttttcaatgttgtgtactttggattgaacccagagggagaaagggcagaggggccttaacagttttttcacaaatcagcctgaagcctggtgataggaccctctaaagatatacagctcagttatcactcagcatgcaagctgaagtggaagcaattagtgttcctgcttaaatggccagagaataacgatgcataactgctgttcacagcactctctctattcccactgtgatgaccctgtaaatgatgggtgcatgctgcatcctccagttactccccaatcacttatactgtgcgccaggcactgtgcaaggacctcaggtacaaagacgactcaggccccttcctaagcagctgaaacacatgcacaacagttctttccatctaggctggataagggccagtgggcagtagcagctgaagtaggtcacaaggtggcatcaacgagaaagaaacatgtgcatgagataaggcatccattttctgcagttctcataaatgaggatatgcaggctgttatatcatgcagaggaaaggcccagtgctcaggaacatccgcaagctccccgctgtctaaatcacctggtctggagtctctggagtctatgatgacaactaaggctgtgatatccacttctcaaggatgctgaggttggagtggtacttcatggaggagattttgtgtgatatcttccacttgactctgagttggcactcagaggagagtgagcacatgtttctgggcagggagggctgcaacatgtgagtggctgagatgaggactttgttctggggagtgttttagtccgttttcacactgctaataaaggcatacctgagacttggcaatttacaaaagaaagaggtttcatagactcacagttccctgtgtctggggaggcctcacaagcatggcggaaggtgaaagacacctctcacatggcagcagacaagagaagagtgcttgtgcagggaaacccccttctataaaactgtaagatctcagcagggtgcagtggctcacgcctgtaatcctagtactttgggaggccgaggcaggtggatcacgaggtcaggagattgagaccatcctggctaacacagtgaaaccccatctctactaaaaatgcaaaaaaattagccgggcatggtggtgggcacctgtagtcccagctacttgggaagctgaggcaggagaatggtgtgaaccaaggaggcagagcttgtagtgagccgagattgccccactgcactctagcctgggcaacaaagcgagactccatctaaataaataaataaataaataaaactgtaagatctcatgagacttattcactatggcaaggacagcacaggaaagaactagcccatgattcagttacctcctaccaggtccctcccacaacatgtgggaattcaagatgagatttgggtggggacacagccaaaccatatcagaggggctttctaatgctgtgtcagattgaagggtggtctgtgttggagcaagaagtgatccataggagaggataactacaatttttttttttttttgcacaaccccatgaggccctttctcttggcatgggtttttcccttcttgagctgattgccagactatagcctttcagagcaggttcccacagtaagattgtgtactgagccttccaaaaacccggatggcaaggatgtgttttaagtgtttgagggtaatcctctctcaccgggacaatttgaaatccccatcttctactgtgcaatttgttattctgggctggaatcagacagactcttctccactaccccatctcctccttctagattggaaaagctcagtcacagttcacatatatactcagttttagtagatcctgcacaacagttttcataagtacttttacaaactttccctcccaccagcaatgtatgattcttcaggttgcttctcattctccccaacacgtgttatgtgccagcattctggtggtgtcagtggctacttcaatttctattgccctggggattaatgaggttgtgtgcctctttataccaataccatgcactctcaatcatgatatccctggaaagtttatgacatctggtagtgtgtgttctctagctttgttcatcttcttaaatattgctttgcctacactttgtgctttgaatttctttatcacttttagaagctgttgtcaaattccacaaaaatgtgtcagttttggatgagattatgttacaattgtagattaatatcaggataatttgtattttagcaataatgacacttgcaatccatgagtatactatatgctccatttgttcagagtatttgataaccccttatgattatgcttaccttaattgatacagaatattcctgcaatgcacaagctatagcaatatcactaacatgtaggtaaatcagagtctttattatatgtatttttcattatcttgggatttggtgttcattcctgaaaacgctggttctcacacttgagtgtgcatcagaatacactttctatgtagagggcttattaaaaaacagatgtctgctctgcaaaccccagaatttctgatgcagaaggtcagggtgaggcccgataatctgcatctctaacaggtcctaggtgatgttagtgctgctggccaggggaccacacttgaggagcccctgccttaaagacaggcagaggaaatagatacattggtccagaaactgtccttgatgctaagaatacaggagggtgtaatcatggtctattactccagagtctctctggctgatgtgggaagcaggaccacagcagatgactataatgcatcttgggaattgctttgcaatttttacttttcaacctgggagctcagtgaaggttgttttttttttcttagggaaataaaaataaaaacaaaaacaaaaatgtagtgctgactggatgggtgagcccctgttgagtaaattccaagagattttgaatgtgtggctgtgtccatactggcaagagatgaatacttgggtgtgaacatatggtgagaaattgctgtgaaatgtggctttctcatccctttttttgtctgctccttcatggaaatttaaacaattcaaaaccatagaaaggtgtccatggttttccatgactgtaatatttctatcagcatgataaggcaatatcatgactgttttaatacaaaatgctcttaggaattgggtctttattaagatataggtaagtgtctaaatgttgggcgtattattttaagtgtgtgtttctaagtgtgtattttggagaaatggccattttcactttgatgggatagttgggatatgatggaacacctggtataatgtttcaggttccatcttttattaggtaatccttcatattattacccacaaacagaaaacgttttcctgacccctgtaacatttcaggatgagaaatggaatgatttctcactcactacttattgtgccatcttaggtgcaggagtgggagggtggaagatgaagctttgctggattcaggattggctgcagaccagcagggatgctttatcttcctggtatttacaagcatgtggaatctcatttctcctgggaatttcttagtttttttcaagagaggatcctccagaagagagaaaaactgagcggctgtgcaaagctgacaaaatgcctaaggaagctgttcaattcaagtgagaatgaaactgcaattaggtctgactttttacagaacaactgagtgtttttattttggggttaacatgtttaaaaccaatggaaagtttaaataagaaaaaatggtgaaaatatagtattatatggaaataattttaacaagatttattcccttgtaagagatttacttagttgctcttgttaatgtgttatttttgttgtttgatattattatcatagtaaaatttcatgcactttgtgggtatgggcatcacagaatgtaaaattaggcagttgggcaaatgatgttttcttcatttggttgtgtgcatataagttacaacagtactttttgaggaatatcaacagaatggctctgggtaatttctggtgtttcctgtttttgcttaaattggaaaagaggctgacatacagaagatttgattgagtattcactggaatagagtcagagcaaggtgatagtggaccactgtgagttttgcaactatcttgttggtcattgttctgtggagggaatggaactttgagttcagatgttacatcactgttgttgatcatttttattgtgatgttaatagtaattgttttctttaggcaactataggacagaacggaagaaagcccagagcgaatcacatgagagtaagaaccaggattagaagtctgaaaaacctgcaaagagacttttatgtcaaagaatgcaggcatattttaggaagagaaagcttgatgacacagaagtaaacaagcagacagaatctctctaccctcatggagctttcagtttagcaggcattaaactagtcatagtaagtaaaattgggattcacatacacaatgaaagtccaggaggctatgggagaatatcacaaggtcttgacctactgtaggggagatcagatcagggggatgcttgtttcagtcagtggtgattaagttgaaattggaagggtgaacatgaattagccaggcaaagaacagtaggagaagttgggaggtgttcctcagactgagagaataactctttggaagccttgagtgaggaaggagctgggcctattggaatcaaaataaaaagcaatgcttctagtgtgattacagcatagtgagcaggagggaaaccagtaaaaggtgaaatgagagatagatcagtcatgaccattcaaaaccatgtttgatatgagaaatgttttggactttatcctgagatcaatggggaggcagggaagggattcagcactgggatgccacaattagatttttattatttgaaggtcattctggcttccttaaaacctaggctgtatgtactgaaaggagctgaggggtatattgtaagaatgcttgatcagggagtcataacttaaaactctataagcaagagtttgttgactcgggagcactctcctaagatgtaggatttaatacactgctaatgacaccagtagatggtataaactcattagtaaaatggctcataggagcattgaaaatgttatggcccatgctaagtgagattgaaatgcaagaattgttgtggcatattgtggtggaagggattaaaggactcagggatatgtacgtgctgcagttgataaactatgtgtgaacagaagcccctccagatgagtacattccattcaaaagaccagaggacacaccatttactgaagccataaagaatgcactgctgagggagatattaaactctctaagacattcaatagtgactctcctcttctgtactaaatgtaggagctgtgtataggagatgctgctgaagatcttggcttgttgcaggatttgggaatataagaccctgaaacaatagtgaagtggcagctcttaactaccagaaaccaaaggttcatactgtcataatgatatgcaaattaacagccaaggaggttggaggtgtagagagtcatggagatgattaatagaacatggtgcccctatgcaaaaagtagagagacagattacaaggataccactttgcttgtaccagaaaaaaaaaattaagtgtaaataaccaggggtctgagggaagttgctcaaataagaaaagcacaaaccctttcacaatttctagacctaaggcagtttttacactcttaaaccttctccaacttccatgacactacagatctccaggtgtccatgtcagctgagaccctatgcctaataggaggtgagaagatacaaatagtggacataatattcttaatagttgtatagtaagtattgaaacactgaacctttattactggtaaaaaaataataaaataggagtgtgtccttaactatataaaaactatatgtatcaaaaagctgtaggaatcactatacttaacatttaaagcaattataataacaatcgccactaacattcattagtacaataaagatcttgttggttaatgagactagaaataaaagtttggattactttcctatgtaggtaatctgaagaaatcaaccagtaagatttcagaactaataagttgtatttaacttattaaacaatctaggcagacttctgtatcattctacaaatagcaattgttgtcccatacactgacaatagccccaaattcatcaattttcttcctaagcatatacatgcaagaactatagaaaaaaagcataaaacatcacttaaagctgtaaagagacatgccattgtaagtcagtggggaaaatgtggcatattttattttaatggtgttgggaaaataggctatccattttggaaaatatttattgacaagcccagataaatacctagatgtgaaatcaaagctataaacattttataaaataaataagagtgtagttttattacctaaagatagaaaaggattgcttaaagaagataaaagtatttataaagaaaactaataaatttgacagcataagacttgaaatatcttacaagtaaagataatagttgagaaaaattggaagaaaatatttaaactgtcaataaaagccaaagataaatatatggaataggtaaggattttatgcaaactcttcagtgaattcaatgaaagcaatactaaaatgtccagggataaacacagaatatgctcaaaggcattaattataatgataaatgtgtaagatgaacactaggaatatcttaaaactaaaaaccaaggccgtgatgattcctagggccacaggtaagtgaaaaatcatgagcagaagttaaaagaaatgagctctgtaactgcaatggtcttccctcaagcactgtgcagaaaagtctcttggactcttggtttctatactggaaaaagtgagattgaggtagatagccagcttctccacaaacttgggttcctacacaagaaaacgattcctgcatcacaagtgcctgccgggtggaaaatcctgaggacaattagagaaagggtggaggtgtggctagcaccaccctgcacatgacaattacggctgctcttcatcccagcaaaaaagacatcaaatcagagaggctgtttaacagcaccacacagtgggtggcacaatacagagatcctttgggcacagactataggcagccttcccacaaacccatggtatattctttgtgaacccctgtccaggacagtcagtgctccaaattttgcaacaacccaagcaatcctggacttagggtgtcatctagtgtcgaaaaggaggcagcaatctcaagctaagggaactcagtggtcaattgacacaaaacctctagacagacataccctagaaaaagcaaaccaagccagacactgaaggctggaataaacaactattcccttgacacaaagacataggcatacatccatcagaaacatgagcaaacagggagccatgaccttcccaaatcgtcaagaaaaggagacagctaatgaccctaatgagatgatgttgtgtgagctctaagatcacaaatttgatgcagcagttttagggaaactcagtgaacgccaagataacacagaaaagcaactaatgaatctatcagagaaatttaacaaagatattaaaataattttaaaaacacacagaaattctggaactgagaaatacaataaccaaattgaaaaatacatggagagtctccatagcagaactggtcaagcagaagaacaaattagtgagcttgaagacaggctaagagaatagcctcaaaagaaacaatcagagagtcataggcctctaaggggaagttgagaaagagcaaggggtagaaagcttattcgaagaggtataacagaaaacttcaaacagagagaaatgtcaacgaaaagagtcaaactctgtaaaatatttgaagagatttattctgagccaaatatgagttactatggctggtgacacagccctcaggaggtcctgagaacatgtgcccaaggtggttggggtgcagcttggttttatacattttaggaatgcatgagacagcaatcaaatacatttaataaatacactgattttgtctggggaatgtctgggttgtggtaagaggttgcagagaccaaagttttccatgaagatgaagcttttagctagcaggcttcagagggaataggttgtaaaatgtttcttacctgacttaaagtctgtgttgacgttaatgagggagaggtataatgaggcatgttcgactcccacgtcccatcatgaactgaaacagtctctcaggttaaattttaagagctgtggctgaggaggaagtccaatcagatggttgggggggcttagaatttcatttttggtttacagaaatatgtaaatatccaggtacaggaaggttaagtgtcaccaaacagattcagccaaaggaagcctaccccaaggcatataataagcaaaatctcaaaggtcaaggacaaagagaggatcctaaaggcagcaagagaaaacaagcaaataacataagaaggagctctgatttatctgacagtggacttctcagcagaaaccctgcaggctaagagtgagtggaattacatactcaaaatgctgaaggaaaaacaacaacaacaactaaaaatactacacccaacaaagctacccttcaaacatgaaagagataaagaccttccaggacaaacaagagctgagggaactcgtcaccaccagacctgtcttaaaagaaatgctaaagggaatcttcaattagcaagagaaagttgctaatgtgcaacaagaaatcatctgaaactataaaactcaatgataaaagtaagtacacaggcaaatttagaatactctaatactgtaattgtgatgtgtaaaccacacttattttagtgtgaagagtaaaacacgaatctttcaaaactgaaagattactaaatctactactaaatttattgcttaatagataatataaaaagaattgaggcaactgcaaatatgtgggctgataaagtgtagaattgtttagttgttgctttgtttttttccttttgatcaaagttatcaccagttgaaataacttgtaataaatctatagagatatttttgtaagcctcatggtaaccacaagcaagaatctataacagagatgcttaaaagtaaaaaaaaaaaaaaaaaggaattaaaacatgccaccagtgaaaaatacctaaccatacaggaagacagttaaaaaaaagacagaaaggaagagaagagttataaaacaaccagaaaataagtaataaaatggaggtagaaggtccttacctatcaataattatattgaatgtaaatggactgaattctccaattaaaagacagagcgaaagaataggtaaaaccagcacctaattatatactcaatgttacttcacctataaagacacacatagaattgaagtgaagaaacagaaaaaaaaatactccattaaaatagaaacacaaaacaagcagtagtaactatgctgctatcagataaaatacacatgaagtcaaaagcagtaaaatgtgacaaagaaggttcattatgtaatggtgaagtggtcagttcagcaattagatataatgattataaatatatatgcacccaataccagagcccccaaatatataaagtaaatattgatagattgaaatacaataatagtagtggaattcaacaccccattttcagcattggacagatcatccagacagaaaattgacaaaaaatcagagttaaactacattctaaaccaaatggatcgaactgacttttacagaatgtttcatctaactgctacagaattcacattcttctcatgagcacatgaaacattctgcaagatagaccatatgttattccaaaaaacaagtcttaacaagtacagaaacattaaaataacatcaagtattttttctgaccacaacactatgaaactagaaatcaaaaacagaaggaatttggaaaattcacaaatacttgaaaattaaacaagatgctcctaaacaaccaaagggtcaatgatgcaactaaaaataacatttttaaaatttcttgaaacaaataaaattggaaacacaacataccaaaacatatggtaagcagcagaggcagcactaatagggatgtttatagcaataaatgttttcatcaaaaaagtagaaagacctcaaattaacaacctagttatgaacctcaaggaattagaaagcaaggacctgccaaacccaaaattagtagaaggaaaggaataataaagattagagcaaaacataaataaaatttagactaaaaaatacaaaatatcaataaagcaaaaaattgcttttttgaaaagataaacaaaattgacaaacttttagataaagaaaaaaattgagagtggtgagagcaacatcgccgaatagaaccctccagtgattgtccccatgcaggagcaccaattacacaaccctctgtttaatgtagcaccttataagaaccaaaaaaatcaagttagtaatcacagcacctgcttttaacataatatcaaggaatgagattttaagaatttaggaaacatagttttgcattgaatacaccaccagtccttaatgcccctgcagtgtcgtgcagagataatctgtgctttggagaaagagagtaaagtgattatgggacttcgctttggaattcagtgctgttctgtcacagtggaacacaaaacaggacataattctgctgctgcccacagtaaaagcaattagatcagccctagccagaggcaaattcttagactcagtgggcagaactcaagttctggctggctccatcactggctaactaaagttgccagttatggaatgaatacctagatcttcaatgcccagacatcaacgaatatcctcaagcatcaagaatatctaggaaaatacgacctcacaggactaattacataaggctccagtgacccatcccagaatgatggacatatgtaaactttcagacagacaattcaaaattgatgtcttgaggaagttcaatgaatgttaaagaccacacaaagaatgacttcagaattctagcaaataaaattaacaaagagattgaaataattttaaaaaatcaaacagaaataatgcagctgaaaattgacaaactgaaaaatgaattagactctcaacaacagaattgatcaagcggaggaaagaattagtgagcttgaagaaaggtcatataaaaaacacactcagaggagaaaataatacaaaataataaagcatgtctccaatatctaaagtagtcacaaaacagccaatttaagagtcattggccttaaagaggagttacagagggagattgggttaaaaaagtttattcaaagaaataataacagagaaattttctaactcagagccagatatctatatccaggtatgagaaaatcatagaacgtcaagcagatccaacccaaataagactagctcaaggtatttaataatcacactctcaaaagtcaaagatcaagaaagattttaaaagcagcaagacaaaagaaacaaactataaaggagctctgatgtctggcagtagacttctgagctgaaacattacaggctagcagagcaggatgacatatgcaaagtgacgaaggaaaaaaaaaccttccaccctagagtattatatccagcaaaatatccttcaaacataaaggagaaataaagactttttcggacaaacaaaagctgagggattttatcaacaccaggcctatcctaccagaaatgctgaagggagttctttagtgtgaaagaaaaggacattaatgaacaacaaatcatctgaaagtataaaacatactgctaatagtaagtacacagacaaatccagaacactctaacactataattgcaatgtgtataccacttttattttgaataggaagactaaaagacaaacctaacaaaaataatagctatggcaactttttgaaactagagtcgaaaactttacaattttacctggtattctattgtattgcagctgagctggcactcaaactgcaagacaaaggttttgccactcttcactccccttttcaaaggcagaggagcctcaccccgtagccactgccacccatggccatgaggagtactactagactaccactgatgttctcttaaggcccaagatctcttaaatcagcttgtgctgaatgcggcctggcctgggactcacccttcaggacagtgggctcctctctggcccaggacatgtccagaaatgccataccagggtcaagtcctggaatcggggaccccaagaacccacttggtgctctatccccctatggctgagctggtacctaaggtgcaaggcaaagtcccctttacttttccctctgcttgtctcaagaaggaggtttgctccatagccgccatagctggtaatgtgctgagtctcacctgaagccagcaagtctcagaggctcacctgcggcccttgacgtagtacttgggtgtcactgctggttattaagggcccaaggactcttccgttagcagctaatgaatgctgacaggactggaaggcagcaattcccttctggcccagggtgtgtctagaaatgtcatctgggagctagggcctggaaagggggcctcttgactgaccagtgcactatactgctgcagctgagctggtatccaagatgcatgacgaagtcctccccaccttccctctcctctcctcaagcagaaggaaagggtctcttttggagccccgagctgtgcaggctgggtttagggaagaggtgattccagcactttcttggctgccacagctgtggcatgcaccccgccccgagtccactgtctctgggcctagttcagccctaggacccacctatgagtctcagtccttatggcctggactgcctttcaacttcacttagagaccgagagcacttttggccctcaatggttagatttgcaggcagaccgcaattcccctctggttaggactgatttaaatgctccctctgtgagtaggtgtcagctgagcttggtccagtttttttttttttttctgctctaacagaacagcactgagttcattgcctcacaattgctgtgttctccctccccccacacccaaagatgctgtcaacaccacgctgctgcttctaggggtttggggaggggtcgcatcagtgattcaggactgttttttctatctcttcagtgcctctttcagtgatatgaagttaaagctagcgatgtgaaattaaaattgtgagtgcttacctgatttttggttcttgtaaggtgtttttgctttgtagatagttgttaattttgtgtctttgtggggggacaatcagtggagctttctattctgccatattgctccacctccttaagccacaatggaatatcattagccatacaaagatgaaatcctgtcatgtgtagcaacatggatgagcctggaagacagacagtatgttaagtgaaataaaacatgcacagaaagacaaatatcgcatgtcctcactcaaatgtaggggctaacaaattaatctcatggaaggagagagtagaatggtgattatcagagtttaggcagggtagggggaaggggaacgaaaagaggttgtgttcaggcacaaaaatacagttagaaagaaggaataatttctagtgatcaatagcaaaggaggttataatttattgtatatttcaaaatagctagaagagaaagttcccagcagaaagaaatgataaatgtttgaggtgatggatatttccattaccctgatatgattgttgcacattgcatgtatcaaattgtcacatgtatcccacaaatatgtacattatgtctcaataaaacatgtgcacataggagcatgtataagaatattcactgcagccttgtttgtaaaaagtggaaatttctaaacatcctaggtgtctatcaatcggagaataatatgtggttgtttaaagaatgtgctatctctacacattgtcttgaattattctccaagacacgttcagtgaaacaaagcaaatttttcaatgatatgttgtgttggtctgtgtactctgagaagtggatgacaagataagattaaaggtcatttatgctctctgtaggaggcctgtgacacacgttctcctggccaccacacagatcaacttctttactaaggtctggggaacatcctcagttcaggatgactgtacatgtacattcatagttacaagggggaagagagtactaggaggcaccaaagtgaatcacccgggcttcacacatatttctccctgccctcattgtgttgctgtaaccttatcccctcctcctgatcaggagcctaccagtatgatgactcctcttcgcacctgctagcttctgagtaccagtcccaaatgacgacagaagatgtaaggaagttataacgtgtagttcaatggggcattttctgtgttccccaagaagagtgaatcagaacgtctctttggagccaagacctccaacagtgcagaacacagagttgtgagtacaaaatccacaatgggtgatcagaagtgatggtaagtggggccactcttgcctctaccactaggttcctggacccatgtgtcctccttactgaggtaaaggcaccttataagttttctgatttaatacatacactggttcctgaaagatagcagcccatcctcccagagtgtttcctctgagttgtgcttcaattgtgcattgagattattctagcattctctgagaatggctatctctggattttgtagcatgtgatatgaccagtgaatcccatagtcaatgctgtacctacttttttatataatgggccccctcatcagatgctatgctatgagaaatcccatgcctgtctacggggtatttcataagctcctgagtatttttgctgggtgaagtgctgcaggcaaggaagacaaatctatagctgggatagggattaatccctgtgaacacgaaccactggcccttccaggatagatgagacccagtgttttcaactgtccacaacaatgaatagtgtaatatttgggactcagagttggtcctagttgctggcaagttgaacgcccagaggcatcagactatatattggtcttggtaagtgggagtccataccgttggacctgtatgaagcttccatttctgccaccatgtacaccttattcatgtgcccattgctggtttggcagtggctgacaagggctgactaatgtcaactggttgaatcattttatttacttgattttcaattcctttcccatggtgtatactttgtgatggatgttaaggtatggtccaaaaatcctcatacgttgtttccattccagcatggcaaaccacaagcttctatttcagacctcattgtctctgatttttcaatcattttctttctagccccaagctagacaggtagggtattgtccactccccagaaatctgtatagataattaattttagatgtcaatttgacgggactaagaaacacctagaaacatcatgaaaaattcttctggagtgtgtctgaaagggcatttcaatagaagattagaatgtgtgtctgagtggcctagctggagaagatccatcatccaatttgccaggggcccagagggggaaaaaaacaaacatagaaaagaccaatgtgtcattctatcttctggaactggtatacacacttcctcttctgtccttgacaactccagactctggggtccttaaatgctaggattgacacaagtggatcccaaggttctcaggcctttggcctcggactgagactaagagttacaccatcaatttccctggtcctgaggccttggcacctggattgaggcacgctaccagcatcccagtgtttccagtttccctacagcctgtctctggacttctcagcctacatgataatatgatataatattcctaataaatttgctcttatatattgattggtagggttgattctaggggccaattatttggattccaactatgaactcaggaactgagcaaatggtcaggaaattactattggataaatctggattcacattgggtacattgtgagccgactttagccaggatttcatttactacctatttcccatgaactcctactttaagaagtaggcattatatacattttgggtttctgagtatcagtgtcaactttgaccctgtgtctaaaattccttgaactatttggtcattccatccagtgtcctatatggccatagatccctctatagaagaaagagaagaatcattgtagcatatacttaccatggtttgcagtgtccttactcctacgaagctaatcacctcttcagtctgtgggtttcagatcagaaagttggctcagaactgggaactgaggaaggaattataactttttcttggagtgactgtacttcaccctctgcttctccatttttgcttttttctgttatacatgctaaacatcacccttattggatccgtgtttattttgcccctaggaataccattatctattagccatctttacaattccctgcagattaagccatattcactgcccttctgaactttttcatcattatagtaattgtggtctctgggcctatagcagagaagtgccacaacatagctctgttactccaggtatccaacaacagaatcaatactgagctgtgctcattaatatgtgaccatttctcccatcatcatccctgctacaggaaagagctaccctcaaatttcctagtgatttaagtgctcctctcactagtgcattcctcatggctttggtgaatcaggtgttctctaggcccggtgaagaaacacaatcctctcatgtgtcttctagctttaaacaatctatccattccagcattctcacctccttcaccttctttattctttcttatatcttccttccgggggaactcaggcatttctatttcactgagatttggccattttcttcaaggtttttagaaccatccagctgtaaattttcaccatttcctggggctcttgctggtgtatttactcccataccctgaggaagcacccccaagtcaaagaattcttgcatattcagccttatattttaatctgcttaattaatccctcgcaagacacacttccaaggacactcctctgctttctgccagtatgtgctagctaatctttgtaatttgtgaggtctatagtctctttctttccgttttaggcccagaatgtccccatttgcattatgctgagattcaaccttatttttcatcctggcatccaagatcagaggtaagggtagcttgtgagccacctgctgcctcatgggggtgaaaatcctgcagcatcttccacaaagtggaatttctagtccttaaaaggggaggatgggccacttctgcatgctcagagggcccaaggtggttacagaggcagcatcctccaaggtgaccatcttgatgacctcttcagagtttttgggatctcaatcttcccttggattggcattcaaacatttctggagctctataatctcataattgcatcttcagactgcctattaacagtatcttctcttccaatataggtgataaagacctctttatatcctacaatgaggctctctggttctcacatttactattaactgatggttacctgctctcagtctttcatttttcttttgcaagtatcaatacaactgagcaattaccagccaattccaccttcttggtagacatattcctaccaatagtttccagatattggcatcactgtacctattgcagtgttcccctgaataggaatatgtgcccgagtcaccacagtcgaaatctttagaacaatttgtgctttgagccatcatcctgtgttatgtgccccacacatgaatagagatgccatcctctttgcctgcagagaagtagatgagccagttccaaatcctgtctttgcacctattttccaaaccagtccttgtactatttgaatctttcaagaagcagacaagaaagctgtattaaacatgcaagtatttaaaaggggaaatgcttgtatgaggaaaatatggaggggttaatgtaaagctgaggaaatcatcaatcatgaagcaagtctgagcctgagagaaggatacagagaaatttgagtggaagtgtattagactgccctgtagtctgtgaaacgtttggaaaagtcctgaggaagtcttcagtcattagttggttctcagaaaagttctgtgtctcaggaataattattcctcaagaacaagttccaggataggtccaagatggctgactagaaatgttggacaacagttatcctcagaaagaagaaccaaagtcacatgtgaataatcataacttgaatagactatcaaggggaaagtattggagcctagtggaaaactaatgggaataagctggggcacagaaaaagaaggtagcaagaggctggcagggattgtctaggcatcccaagtgacttaacatttctttttatttttttattttttttgagacggagtctcgctgtcgcccaggctggagtgcagtggcgcaatctcggctcactgcaggctccgccccctggggttcccgccattctcctgactcagcctcccgagtagctgggactacaggcgcccgccacctcgcccggctaattttttgtatttttagtagagacggggtttcaccgtgttagccaggatggtctcgatctcctgacctcgtgatccgcccgcctcggcctcccaaagtgctggaattacaggcgtgagccaccgcgcccggccgtgacttgacatttcatcaaagtggcaggttggaatgatctgagtcctcttggctctgtggcagaccactggtatccaaactgtaagagagtttctctgcccacatggacccaaacactaatgttggtggtgatttggggattttttgaggtctttataccacactaccaactcactccccattgctctccctccccaggaccagaactgtggctgcgggtgccatactacaggagcaggcctcaggggagcattttctgcccagggaacctcagcctctgtctgtccacattacaggaaccaccctcttccacagacattcccccgggcccacacggattgccacagttgcacaggggtggccagacccaggggagctacagaattttcagtggtctagcctttggactggtgcttataagggaagggagagtgtaatgaagcgagggaacagtttttgggacaaaggaaagcagctcatgcattttccagtgcacaagagctccttgcttgtgagctctcagggatggtgtcacttccagcagagacacaggggctgtgctacactctgcaaaggaggagtgtagtttcattgcagcagccaagtggcctcagtgctcaagtcaaggcatggagaggggcacttcccctctcctccctgctactgatacagacagaaccatggctgctcccatgggaaattgacctgggcatgctgggggacagactttctggggctgctaggggcaaatgctaggtcctgctcctcctatgaaagatacgtgctcccactggcagtgtggccaccaaactgcatgaaaggtgcctcccaacctcttacatgtggtggcagcattcctgcaggggagagcaggagagctggtgtgttttggtctgatggaataagttcatcacagccattttggcagtgagctctgggacaggcatttttcatggctctcagctacactgcagcctagagatagatggactttaaattaggaacagttactaaggaaaacaaagttcattatgtaatgataaagggatcaattcaagaagaagatgtaacagtcctaaatatatatgcactcaatgctggagtaaccagattcataaaacaaatgctactagacctggaaaaggtatacaaatacgtcaaaactaaacaacctgcttctgaatgatctttgagccaatgatcaaattaagacagaaatttgaaatgtattgtaattaatgaagatggaggcacagtataccaaaacctctaggataaagcaaaaacagtgctgaacatctacattaaaataataggaaggtcacaactcaacaatctgatgtcactcatccagaataatgctcatcaataaaaaagaaacaaaccaaacctaaagctagcagaagaaataaaaaagatcagagcagaattaattgaaaatgaaaacaataaaaataccaagtgatatgatttggatctgcatccctgccgaaatctcatgtcaaattgtaatccccagtgttggaggtggggcctggtgggaggtgattggatcatgggagaagatttctcttttggtgctgttctcatgatagtgattgagttcttgtgaaatctggttgtttaaagtgtgtagcacctcccctctctctcctggtcctgctcctgccatataagatgcctgctcccacttttcctttcaccatgagtaaaaggctccttgaggccttcccagaagcagatgcagccgtgcttcctgtacagcctgcagaaccatgagccaattaaacttcttttctttataaattgctcagtctcaggtatttctttatagcaatgtgagaatggactaatacagaaaattggcactaagcagaaggacattgctataaagatacctgaaaatgtggaagcagctttgtaattgggtaatgagcagagattggaacagcttggagggctcagaagaagatgatggaaagtttgatacttcctagagacttgttgaatggttatgacgaaaatgctgatagtgatatggacagtgaagtcctggctgagaaggtctcagatggaaatgaggaacatattggaaactggaaaaaaagtcacttttgttatgttttagcaaagaatttggaggcattgtgcccctgccctagggatctgtggaactttgaacttgagaatgatgatttagggtatctgttagaataaatctgtaagcagcaaaacattcaaggtatggcctggctgctactaacaacctatgttcatatgtgtgagcaaataaacgatctaaaacttgaactcacatttaaaagggaagcagagcataaaagttagaaaaattggcagcctggccatgttgcagaaaagcccactttctggacaggaattcaagcaggctgtgggaatttgcgtaggtaaagaggagccaagtactgatatccaagacaatggggaaaaggccttgaaggcaattcagagaccttcatggcagcctctctcatcacaaacctaaaagctcaaaagtactaaatggttttgtgggccaggcccagggtcccaccatcctgtgcagccttaggacactgctccctgtgtcgcagctgctccagctccagctgtgactcaaaggggcccaggtacacctctagctgctgcttcatagggtgtacaccataagccttgacagcttccatgtggtgttaagcctgtgggtgcacagagtgcaagagataaggcttgggagcctctgcctagatttcagagaatgtatggaaaagcttggatgtctagggagaagcttgctgcaggggcagagccttcatggagaacctatgctaggggagtttggaggaaaaatgtatgtggggttgaagccgcctccccacaaagtccccaatggggcactgcctagtggggtgtgagactcttctcacaccactgtcctccacgctccagaatggtacgtccaccaacagcttgcaccctgtacctggtaatgccgtaggcactcaaaaccagcctgtgaaagcagctgtggggactgaatcctgggaagctccaagggtagaactgcccaaggctttgggagtctaccccttgcaccaggatgccctggatgtgagacatggagtcaaaggagattattttggaatttttagatttaatgacttccctgctgagtttcaaatgtgcatggagcctgtagcccctttcttttgaccaatttctcccttttggatagggaatatttacccaatgacattgcatcttggtagtaactaacatttttttattttattttataggcttataagtggaagggactagccttgtctcagatgagactttgaactgtggatttttgagtcaatgctggagtatgttaagactttgggggactgttgggaaggcataattatatttcacaatgtagaaggacatgagatttgggaagggctagaggtgaggtgatatggtttggatctgtgtccctgcctgaatctcatgtcaaattgtaaccccaatgttggagatggggtctgatgggaagtgatcagatcatgggggcagatttcccctttggtgctgttctcataatagtgggcatattctcatgagatctggtcattaaaaagtgcgtagcacctccctcctctctctcggtcctgttcctgctatgcaagatgccagttcctgctttgcctaatgctatgagtaaaagctccctgaggcctctccagaagcagatgctgccatgtttcctgtacagcctacagaattatgagccaattaaaactattttatttgtaaattactcagtcttaggtattcctttagagcaatgagataacagactaatataccaagggtcaacaaaatgagaaattggttgtttgtaaaggtaaacaaaattgataggctaaccaagaaaagaatagagaagattcaaattggcacaatcagaaatgtaaaatgagacattgccactcatatcacagaaatacaaaagacgatcaaagaacatctctatgctcacaaactagaaaacctagaggaaatggataagtcccggaaacatacaaccttacaagataaagctaggaagaaatatgaatccttaacagactaataatatctagtgagattgaatcagttataaagaatcttccagcaaaaaatggtacagggccattttttggaaccacagccaaattcaacctgacatatgaagaataactggtaccaatcctatggaaactgtgctaaaaatatgaggaagaggaatatccctaattcattttatgattccagtatcaccctgataccaaagtcagaccaggatgcaacaaaaacaacaaaactacagaccaatatccctcatgaagctagacgcaaaaatcttcaacaaaagactagcagactgaatccaacagcacattaaaaagataatacacaacaaccaagtggattttattccagagatgaacaatgctcaacgtatggaaatcaataattgtcattcatgacttaaatagaattcaagacaaagatcatataagcatctcaatgggtgccaaaaagcatttgataaaattcaacatcccttcataatatatatcctcaacaaactaggcataggaggaacatagctcaaagtaatgaaagctgtatatgaaaacccacagcaaacaccacatattacactgaagagggaaaggttgaaagcatccttactaagaactggaacaaggcaaagatgcctactttcaaccccctattcaacatggcactggaagtcgtagccaacacaatcaggcaagagaaagaaatagaaagtatccaaattggaaaaaataatggcaaattttctctgtttgctgatgatataatcttttgttttcatatcttatttttaatagcttattgaattactttaaggtgaacatccttgtgaccaacatgagtcaagaaattcaagtttaccagccaccccagaagcccttacatatgctccatcccaattacagcactctctttcccttaaaaaatgacaactatcttaaattttataaagtgatcacttgtttgcatttttaaagcttttatcacctaagtgtgcatcattaaatattatagtttaatcaggcccatattaaaatttatatgtttcagtcacttttaatctaaagctccctctttgtgcctcctttttttcttacaatttataccagcctatttgaattttagaatttcccaaagtagaatcttatgcctagaaaaccctaagggctccttcaaaaaactccttgatttgattagtgaacttagtaaagttttaggatacaaaatcaacatacaaaaatccgtagcatttctagacaccaataaaaatcaagcgggtaaccaaattaagaagtcaattccatttacaattgctacaaaaaaatgaaatacctaggaatacatttaaccaaaagggtgaaagatctctacaaggaaaactataaaacactgatgaaagaaattgtagatgacacaaaccaacaagtggaaaaatattccatgttcctgaattgaaagaatcaatattgttacagtgatcatacttcctaaagaaatctacagattcagtgcaattcctatcaaaataccaatgtcatttttcacagatttggaaaaaattactctaaaatgcatatgggaccaaaacatagtctgcatagccagagcaatcctaagcaacaagaacaaagctggaggcatcatattacatgacttcaaattataatacaatgctatagtaacaaaaacagtatggtactgatataaaaatagatacattgatcagtggaacagaatggataactcagaaataaaaccacataccctcagccaactcatctttgacaaagctgacaaaaacatacactagggaaaggacaccctattcaataaatggtgctggaaaagttagattgtcacaggcagaagaataaaactggactcctatctctcaacatatacaaaaattaaccaagatggattaaaggcttaaatgtacaacatgaaactatgaaaactctagaagaaaatctaggaaaaactcttctggacattggcctacgcaaataattcatgactaagaccccaaaagaaaatgaaaccataagaaaaatagacaagtgggatttaattaagccaaatagctaaaccaagcaaaagaaataattatcagagtgaacagacaacctaaagaatgggagaaaatatttgcaaaccatgcatttgacaaaggactaatatccattatctacaaggaactttgacaattcaacaagaaaaaaaaccattaaaatgtgagcagaccttttacaaaagaagatacacaagtggctaacatgtatatgaaaaagcccagcatcactaattatcagagaaacgcaaattaaaactatgagataccatctgacactagtcagaatggctattattaaaaagtcaacaaataacagatgttggtgatgatggggagaaaagggaacatttatgcactgttggtgggaatgtaaatttgtacagtctctaaggaaagcagtatggtgatttctcaaagagctaaaaatagaactgccattcaatctagcaagcccactactggatatctacccaaaggaagataagttattatatttaaaaagacatctgcacacatatgtttgtgacagcactatttacaatagcaaagacatgaaatcaacctaacttgtccatcaacggataattggatgaagaaaatgtgatggaataccactcagccatggaaaagaataaaattatgtcttttgtgtaaacatggatggaaatggacgctattatcttaactgaaataactcagaaagtcaaataccaaatgtccatatattagtgagagctaaaaaatgtgtacacatggacatagagactggaatactagacactggagactcagaaagattggagggtgaaagcagggtgtggtatgataaattacctactgagtacacgtacgttatttgagtgatgtttacactaaaagtccgtacttcatcactatgcaacaacatatccatgtaacaaaactgcacttgtaccccctaaatctataaaagtaaatacataaaaatttaaaaaataagaaagaaagaacaagtccctgccacacttggtcattggctaagacaagccaatgtgagatttgccttcgacaccaacacagaaatgcatttacaaggacagcagctgacgtcttttgtcaattacactctctataggcagagttttgcaaggaatattattgcggccattacatatatactcccaaggatgctattactgttacaaatacccttcagaaaaatatggctatttctaattatacatctaaatgtatgtatatgcatgggaaaaaaggtgtggaggagatatactaaactaacaagagtggttacatatggttggaggggtgggaggtggcatgtataatggatagtcaagaaggattaacagatttaaatgttttgtttaaaatttaaacataaaattatattgactcatgtattaattgtagaaggaaaaatataaattttttaaagtagaaaatccaaacctagtcaacatttttgaaacagtggaggagaaagatgtgattatacaagaccaatgccttaccacttggccacaacacctgataaaagatgttcatataatggcatgatcttgcttattgatctttgtcatttatttaaatgatgagagagaattgagcttctttaagtgctgattagagggaacaggtatagaaaagagatagagaatagtgaagggcaaagagatgaatgatagaagacatttcctgataaggtagagaaaaatgggatctggtacagagttgtagggattggcctttggttagagtgggaaaacctcttccactgcaacaggagagaaggataaggagatgcttcagatgaagtggaattcctacatcctagaggatgttaagagatttcccatacaatggcctttactgatccttgtgatatgagatagagtgatcttttaagagtgaacaggcaaacaggagcccatggtcaaatgtttgaggagaaaggaacaggctcagaagagttcttgaataaattgaaaagatttgctgacatgtgatccacattgcatgagtgtttagcatagcggaaaatccacttgcaattggtgatcacaaatccggactggaaccagtatgactggctgtgtaattttatccaagtgggtgagaaagtcccaacgaaggtaagaaaggatagatgtttgggttcatttaaggttctgtgttgctgagtaggtgtgacagtgaagatatggagaataaggaagtcttatgtaataacaagagagcgaatgaaaaatagaagggtggaattctagacaagattttttcaagatgttgaggataaagcatcaaaaaatggtaaagtaggcagctccaagcacctgtctctccacagtaacactgaaaattaagcagaagttgttaaaacaaagtttgtcagacactggcaaacagccaaagtcttatagcaacaaaaacaaaatgtggtgaatcaaaaagaaagcaaacttgaaatggtaggaaagctttgtagtgtttacttcacattgccccacccactccatggctctgcagccattttaaagatggtagcctgtgtttccaatgtgaagccccgattccagattctagaaggagcagaacagatcatactcacaaatcattctatttgtctgtcctaaccttctgggagctgccttaaggagtgacacaggcacccatctctgtttcactaatgtggaatccactaagtgtgggaaagcagcagtcattgctgaaaaacattgtgcagataactaaaacctgaagcttctttgggcaaaatgctatggttgagacatacagtagactgcctaaagactcataggaaaagtcagggagagcctgtttgaaaagttagggcattggattgaaggaaaaaaagggggcttatgtccaaaatatatatgaaactcaatctactcattaagaagaaaacaaatcattgaattgaaaaatgggcaagggactcgagttgacatttctcaaaagaagacatacaaatggccaacagatatatcaaataatgttcaacatcacaaatcatcagagaaatgcaattagaagtgtaataatatatgatctcatacatgttagaatgcctattatcaaaaaattgaaagataagggttgatgaggatgtgaagaaaagggaaaaattgtatgctgctggtgggaatgtaaattagtacagccattttgggaatagtatggaggttcccccaaaaatgaaatatagaattattggatgatcttgatatccccttctggatatatagccaaaggaaatgaagtcagtatgtcaaagagatgactgcactaccatgttcattgcattattattcacaatagccaaggaaaggaaaacttcagttcccatcagcacatgaataaatttttaaagtgtggtatttatataccatgaaatagtattcagccataaaaaagaaggaaatcttgtcagttgtaagaacatgaatgactctagaagatggtatgctaagtgcaatatgtcaggtgcagaaagacaaatatggcacaatttcttttatatgtggaatctcaaaaagtcaaactcatagaagtggagagtagaatggtgattacaagaggcttgaagtgggtgtatggggaaagggaaatgttggtcaaagggtgcaaaatttcagttagacatgaggattaagctctggtgatctattgtattgcacggtaactattgttaataataatgtattgtatacttgaaaattatttaaggactggacttaaatgatctcattacaaagaaatagtaaatatgtgaagtgatggatatttagttagccattgataattccacaatatatacctgcacggatggaagcatcacattgtaccccataaatgtatacaatttttatttgaaaattaaaaatatgaaaaaatgtataaatggattaagttctctaaccaaaagggattgccagaataatttttttaaagccatgatgaactacatgcttccaacaaaagactcactgtagatcccaaaacacaaataagttgaaggtgaaatgaagcaaaaagtgattccatgcaaacagcaaagagaagagagctggggtagctatactaatatcaagcattttggaactgagtaaaaaattgtcacaagagacatggagggacattacacagtgatcaaagggtaaatttatctggaaaatatgccaatgataaatataggtgtacttaacaacagagatccataatatatgaagcaaaaattgaccaatttaaaagaaaaaatatagacagttctaaaataatagttgaaggtttcaaaccttacgttcaattattaaatggaagacacataacagcataaaccaactagatataacagatatatacaaaataatccatcaaatatcagcacaatgcacattattttcaagtacatatgcaatgttctcaaccataggacatatgttaagccacaagacctgtggcataggcctatggtaggtctcaatgaatttaaaaagaatgatctcatacaaaatgtcttatctgaacacaattgaaagtagagatcagtaactgaaggaaaactggaaaaatcactaaaatttggaaagtaaacaacacacgctgaaacaacaaatggattaaataagaaatcacaaagcatactagaaaataggaagaaatgaaaatgagaaaaaaacatgataaaaagcataggctgccatgaagtcaatgctgagagggacatttatgtgatatgtaatataaatatctacattataaaaaaagaaatatttcaagtgaacagcctaactttatacattgagaaactatagaatgaagagaaaactaaatctaaagctagtagaaggaaagaaataacaaagaatagagtggagagaaatgaaatagaaagttaaagaaacaacacagttgtagctcaacttacaacttaaaaaaagaaaagacacaaataaccataagctgaaatgaaagtgagaacattactacagacatcacagaaataaaaatgattataagagaacactatgaataattgtatgccaacaaattagataacctggattagagaaatccctagaagcacataaattacttaaactgactcacagagaatgagaaaatctcaaaagacctataacaagtatagacactgaatcagtaatcaaaaacctcccaagaaagaaaactccaagccaagatggcttcactcatgaattctgccaaatatttaaaacatagttaacaccaattcttttaagatttttcaaaaaattggaagatgaaataacacttcttaactcattctatgaggccagcctgcattaccctgacaccaaaagcagatacagggagcataaaaaagaaaactatagaccaatatcccgtattaatatggatgaaaaaaagtcaacaaacgagtagcaaattgaatccaacagaatattaaaggaattgtataccatgactaaattgaatgtgttccagaaattcaagggtatttcaacatacaaaaatcaatcaatgtgatacacaacatttgtataatgaagaaaaaccacatgatcatgtcaatggattcagaaaatgcattaaaaatctatcgtgcttttatgataaaaacatgcagcaaactaggaaatcatggaagcttcctcaatatcataaaggccatttatgacaaattcacagctaggatcatacccaatggtgaaagattgtttcctctaagattaggaacaagacagggatacccactttaaccacttctattcaacatactactggaagttccaggaagagcaatcaggtaagattaagagtaagtaatccaaattccaaaagaacaagtaaaattatctgtattcatggatgataagaacttgtatagtgaaattcctaagaaaagtccacgaaattgtacggttaataaattcaggaaagttgaggatatgagaaaaacacacaaaaatcacttttgtgtttgtacactagtaccagaatctgaaaaggaaattagtaaaccaattccatttaaaatagcatccaaaagaatataatacttacaaataaatttaatcaaggaagtgaaagacttgtacaatgaaaactacaaaagattgctgaaaacaaaagaaaacctaaataaatagaaagctatctcgtgtatggactggaagacttaatattgtaaagatgacaatacaggtcgggtggggttgctcacgcctgtaatcccagcactttgcggggccgagatgggtggatcacttggggccaggagttcgagaccagcctggctgacatggtgaaaccctgtctctactaaaaatacaaaaaattagccgggcatggtggcaggcacctataatcccagctacttgggaggctgaggcaggagaatcgctggaacccggaaggcagaggttgcagcgagctgagatcgcgccattacattccagcctaggtaaccagagtgaaactgcatctcagggggaaaaaagaaaagaaaagaaaacaaaacaatactacccaaggcaatctacagattcaatgcaatagctatcaaattagcaataggattttttatttttgcagaaatggaaaagccaatcctaaaattcccatggaattgtaaggggcccccaattctctcaaacattcttgaacaaaaagaaaataattagaagactcatatttcctgatttggaaacttaatagaaatctgcagtaatcaaaacagtgtgatactggcatatgcatagacatataaatcaacagaatagaactgagattccagaaataaacacatacatctacagacaactgatttttgatgagtgtgtcaagttcattcaatggaaaaataatgctctttttaacaaatggtgctgatacaactggatagccacatgtaaaagaatgaaattggacccctactcacactatgtataaaagataactaaaaagggatcaacaaccttaatataagagctaaagctattaaaattttagaagaaaacatatgggtaaatattcatggcctaggattcagcaatggattcttagacatgacacaaaaaccatgagcaacaaaagaaaaacagatatattgtacttcattaaaattaaaaccttttgtacatcaaaggttattatcaagaaattgaaaagaaaaatctgtaaaatgggagaaaatatatgcaaatcatacatttcttacaagcatttattatccagaagatgtaaagaactcctgcaactaaacaacaaacaaacaagcaacccgatttttaaaaatgatagaggacttcaatagacatttttcaaggaagatacagaaatgacccatatgcacatgataaaacctcaacatcattaatcattagtgaaatgcaagctgaaaccaaaatgggatatcacggcaccttctaggatgtctatatttaaaaaaaaaatgaaaatatccagtgttggtgaggatttggagaaactggaatgctcattcattactggtgggagggtaaaatggtgcagacactgtggaaaaaaattgggtggttcctgaaataggtaagcatagagctatatgatccaacaatttcactcccaggtaattagtgaaaaaaaaaaaaggtaaacagtaacttgaacagatacttgcatgtccgtgttcattataacattattccaaaaagtcaaaaggtagaaacccatgttcatcaacaaatgaatgcataacaaaatgtagcatacacatacaatggaatataattcaaccataaaaaggaatgcgtttctgattgatacatgttacaacatggatgaagcttaaaaacaatttcccaagtgaaataagccagacacaaaaggacaaatattttatgattctgctgttatgaattctctagaatgggcagattgatagagacagaaagtacatttgtggttttcaagggctagggggagaaggcaatggggtgttactaattaatgggtatggagtttctgcttggaatgatggaaaagttttgaaaatagtagtgatggttgtgcagcattgtgaatattactaatgctgcagaatggtacacttaaaaattatagcccaaatgcctttcaaatgttgttggataagcaaattgttgtacatccatacaatggaatactactcaacagtaatagtaaactatttgatatgcacaacacttagaacaatctcaaaggcattatgctgagtgagagaagtccatctcaaatgatcacactctgtgttattccatttttgtaattattcttgaagtgacaaaattatactgattaaaaagatattgctaggttccaaaggttagtgttggagggagagtttggctgtaaaagaggagcaaccagaacagtctttgttgtgataaaacacttctatatcatgactgtgatgatggttacacaaatatgtacaaatgacaacatctcacacacacatatgccataagaaagtatatataggaatgtgaaatcagaataaggtctgtaagtgaattgatagtatggtgccattatagattttctgacttttataatacaccaagattatgtgtcatggttatgttatattttggggaagctgggtgaagggtgaaaggtacagtgaattctctgtattatttttgcaatttcttgtgagtcaaattttttcacgataaataacatataaacataagaaaggaggcaagattgcaaaatatttgataaactatacttgatgatgctcttcagtaaagaggaggtaatgtctttgtcaaggaaagcagcaataacttcgacctataaatacctatacaagttattgcaacactgtttacttcaggaaatgaagctctaattccattgtgactatatcgtacatgcaataatttttggaatgcgtagtactacctgatagggagagtgataagaaaaatctggtctaacataactaaatttcattttgggtttaatatgaacaattattagccaaaattcagagtccatctagcttctacattttgttttcaggagatgactattaacaaaaaaaaaatacagtaagcagcttggaaaatgacaacaacatcagaagcccctttgagactagatggatgccttacccattgtgaagggctttaacacttggcctgcctcccttcctgtctccctttcatcggcgtttattcctgaaaaagagctgccaaccagaaccagctattacttggcatatgggaggcaaaagccctgtctcagagactcacacaactgacatctgagcaagggtgttgcattcattgttttctctatggggaggcaccagtaaattactaagagacttctaaaaagatttcctcaggtattgtctcctggtcaatgttcacataatatttagttgagttttataatacagaaacaaccaacaatgtaggcagtagtctgaagcagctctatgactcagatccagcctcttttatctgcagaccaaagccagtactgtttgcccggggcccacacagtgacccagtgggagccctcccacagacctggaggaagccacccctgtgtgtaaccaggctacagacttttagtgtatgggccctgaagtggaccctaatcccagcaccagccctactgaccagatcctgaaagcagtcaagttcacctagagaccaaactggattcaggccctcttgaattaacaagcccaccaaccatagaccctgcttgcagaacctgtagcaactacatgtcattgctccctccccactcaactgtgatcctggaggcaatctcatcagactgaggacccaacaggagatggtctttatcagtcaaaaccagtccataaagactggggttggctccttcaaattacagacaccaataaatgtctacagggatcacaaagaatgaggcaaatataacagcaccaaaggaaacaaatgaaactccagtaaactaccaaacaatttgaagtctataaattgcctaaaaaagaactcaaagtaatcatcttaaacataattttgattcatgacttaaacagaataaagaacaaaaaacatatgatcatctaaatagatgcaaaaaagcatttgataaaattcaacatccttcattatatataatacatcatgccattctcttttccaatttgaataccttttatttctttctcttgcccgattgtgctggctaggacttccagtgccatgttgaataggagaggtgaaagtaggcatccttggcttcttccagtacttaggaactgctttgaacttttccctgtttggtgtgatgttggctgtgggttttcataaatggctttcattattttgaagtatgttcctcctccgtctagtttgttgaggatgtacatcattagtttctttctattactagatattggcaatgttttattataaatgcagtttgagttttttcatacactttgctatgctgtataatttgctatacttgagttttatcaaacactttgctatgttgtatgattaaatttattgagataatcatatgatttccatgctttattctaataatatagtggattatacaaatttatttcttaatagagctatcttggtcttgatatattcttttgtgtatagattgctgaattaatttaccaacgttttcttgaggattttccatttattttcatcagtgtgattgatttcttattgccctttatttatgcgtccattgtcatatttactatcaaaattatcattatcacatgatataaactgggaaatgttctttctttcatatgttccttaggagactttgtataaaattgagattattttcttctgtaatatttggtgagtctagcgtattttattattgcttttactgtttgggggaagtattttaaattacccactcatttattttaatggctataggtctagtcacaatttctgtgtcttcgtgagtcaagtttgttgagttatatttttctaatgtttgttaattcactacattaaaatgttcaaatgtattgttataaaatgttacatgttttctcataatcctcatttatccctatgatatatcactcatacacaaaaagtgaatgaaatataaatatgtgtgtaaaaatgaacacctatagatcattaccaaggtaaagaactagaacattgttggcattctcaaagtccccatgtgcctcttcctggcatcttccaccctcactccttgaggtgaccactattcttttttagtaattacttctttgctatgctgtataattttccaactacatatgcatctctggaaaaacagagtttcattttccgcatttcttagatatatatgaaagttatcagaaggtgtgcataattctgtgtctggcttcacctactcatcattatagttgtaaaaatcattttcattattgctccctagcattccattatattaataggccaaaaatgcatctatttatccttctgttggtgaacatttaatattcaaattggacagtcaatttcccatggtctgcaatgccgaattatcattaatgaagtatttcatatgcaaatgagtccgtgtcagcaccatgccaacttcacacctggttctttctaaaatgaatcttctttttcatgaacatttgaatattatataaattttagaatcggtttactaatttccacacactaaaatacagagttttttggattgcattgaatacgtagatcaattttgggagactacgcatttcaaaactatagaattttccaggccatttacatggactatctctccatttatttgttctctctcactagagcaaaattccatggcagctatggtggccaccctaggatggcctgcactctggcaatccttctgtatcaacaggatctgtggacctccaaacacaatgtcctgaatacccagcaataaaaaaaggatcggcatgaagctcactctgacaggatgagggaaccacccatgggagccagaaaaacctaggaacctgattggtactggatctaaagttatgctcatctcccaggaacttgatctgcatagtcactgaggtcatcagtcacagggttttgcccctctatttacccacctcatgcagctttgcactttctcccttgctccttgcttctcatggccttccttagctgcctgtcacttctcacccctccacccaccacatatccctaaccccacaggagggagatacactgtagacaagagaggaaagacctggccattgccagcaataaatagctccctgtactggtatgccggaccaccaggggatacaaaagatgttgtttcccagaatcctagagagtggcagtcactgggtgatcttagcgtttatagactggatgtttttgttcctcgcaaacccatatgtcgatacctagccccgtagtgtgaggatattagcaggtggggcctttgagagctagttaggattaaataaggtcataattgtggaaccctcatggatgggattcgtgtctttatgggagtcaagacagagcttgcttcctctctctgctctctgccatgtggaggtacaaggagaagtcagctgtctgcagcccagaagagggccctcaccagaatccggccacactggtatcctgatctcagacttccagcttccagaactgtgagaaatacgtttgttgttgataagccactcagtcgatggtgttttgttatagcagcccaagctgataaaaacaagggtgttctaagaatgggcgaggtgtccggccttcctctggtcctttcagccagcagatctcccactcaccttgcagcaaccagcaggtactgatgagtctgagatgccgtgagtctgctcaagtaacttttctagacactcattgcagattcctcaacttctctcactatggtttcttgttcacctgatagggcccactagatccagaatccggaatttaatgaaatagttgctaacaaagtaacgtaagtacaaaattatgtgaaggttgaaagtaattagttttaaatgcctcattattttattatttcaaacacatggacattatacaaaaattgaaaatacagattaacacaaaacaataaaaatcagagattatgcattattttaatttaatgtttgttttctgttcactttgtacagtatgcatagattctgtttctagtcataaaaacattaaaaatgctgagtctatttgtgttttggttcatgttgagcactgcagtgggtctttgcttttctagtttttgtaatcatgaattcaaattgctgaagtcatagggcccactgctccagcattaatttgctttgtagctttcttgagttttcccaggctgtgacatttggaacttgacaagtcaatgtgccgagcaatgaagatgacttatttgatgagactggtgttcttttccaagcagctgatattatgctagagtcagcttcatttaaaaagcaggtgcaacaggaaccgtcccttgaaaatgtagatcccatcccagtattagaggcagcaattcctgtgataaagggatagggggagcaaaagatgaggccacagggaagggtctctaagggaccctaaaagctgcctcatgaatccagagtccattcaaagctctccctcctatttcttgaaaagattggccactggggtgttgagtttagagaaataggtatgagcctcataatctcaacccccagccactcccaacagatctgacctttactgtctgggcttgccatgtggggattgtgcttaccatgcctggcaccctctccactcaccaggtggtgaagtgcagctgaggcttggggtgggtcatatgtataaggggtgggggcaggtacattctgaataagggaactgtgagacaacatgcctcctctcgagcacctcaatagacatttacataacctaaggacacgtgaagatgttttcttttggaagttttactggtgatccacatttttaaaaggaatataattgtcaccagaaaatactgttgaccttttgttctccaacaatgaccaaacaacaagaccaaaattaaacaaaacaagcacctttcactattgttattgcactcaacagcaacttctcaaactaggtcctctcagccaaaactgtacacttgaatcttacttggaacgatagctgtatttttgaaaagttatatacatcacattttttctttggttatgcattcattaaacaaatatgtatttatctcctactatgtaccaggtcaaattctaaacaaatgtaattgtgctaaaatgttctattagaaagaattcttgttttagaaaacaaagtgaataaagtcccttttacctgtaatattttaggattctagttaaagtcacccaaatggatcccttttatgaaatacagtccttcaaatttgtttatttgaaaaatttacattttatatattttgcttaattacgggatacctatatcaccttcttttaataaaattataatgtctgtctaggtgtttgtgtacagttagaataaaatcttaagaggtcctctatgtgatcccacccagtgagtgattccttcctacaacttccctgggaacgggcatttaacttctgctggaacatcgctggtgatgggaagctcactacctcacaaaacattttgttctaggatcattctcctcctttaaaaaggtccttggtgaatttcacctacaatgagggtgaaattactagtgtgctgccagtcatctgggtttatctggaaaaatagtaaaaagagtagtagctcatatggcctgagacaaacatggtataggagagcttcaagaaaggatagcgggtattggggaagaagactctgaaggtcatagaaagatctagtctgagtccatggtggagcctgctagagaccagaggaggttctcttggttttagaaatccagctggcaagcagggaagcctttgtgactggagcagaatgagagaggaagcaggaagaggcagctgagggcagagagggaggcaggggctggatttggattttcttccctaagtttggaggaaaacatttgtgtatttttcagcaggcggtgatgtttttggctttttgcttttaaaataccatgattctatttggtcaaatctctcagcattccccctgccctgtcactttatacctcactccagaaaacctggactactcatagtctcctgaatgtaccaggtggaagaagcctatcatggttccttacacttacctgcccatcagcttccctgttcctgtcattccttccttcccctccttgtctacctggcaaaaatctcactttgctgccaagttgggctctaccatcacctgctctggtagacttcctttactctctcaagccagtctgggtgctttgtatctccattacctcaggtagttacaattggtgatttatgtgaagccctcgagggccagggcagtatttgcttcacctctgagtccccagcatctaacactgtgtctggattaaccaactaatccatttacaaattgtcgaactcttctaaaacaatgaaataaaaatttgggagcagatgtattctaaaatataaccagttcatgtttggtgataccatatggtacattttcatttcttttctgggtatcttttgtaactattttttcctggtaagatcgtatgaaaatagcatagctcatattagctgtttcctgagtgcattatagagtcttttcaggatctgtgatagatgacccctgacaacttctttaaaaagttccaagtcaaaaccatctacgccatgctgtaaggagtagaatctggggtcctggacaattgtttgctccaatagcaatagctacaaaatgtaggacttacaagaataactaaggaaagttaccagggcaaggagctggaggccaatagcaaagtttatcaattcatcagtcaatagatatttagattgtttagattgtttgcacatttgggctattatgaaaaatgacttttttatggtgcccaagaatttcaatttgagaagcagaagataaaggtagggtatgtgggaaaggcctgtactggttaactagatccttttccataatcagtatatctatagtagggagtgtaagcattgaaagacaagcaatgtcatcatcagttgctcctagaagtattctagttctccaagcttgaaaagtgaagagaagcctctgttagaacagcctctggcacacaagtgcacccagcatgtcccagtctcatagaaggcccccaacaggtgttagatggatgcaaaagaatctacagaaacagccaaaggccggaagttgtttgttgttgttgttgttgttgtttttcgtctccaatgcaaatccagaaatccatagcacaagccattctcaagccaggaggaaacaacaaaggggaagttttcacaacccccttgcatcacagtttcaaaatcaggctacatttcaagtaactagtggtctgaagcctaaccatataaatttaggactgctcgaggggaaaggataacagcagcagagccactgatcactggattgtttcaatgagctcagtctcctgcatgtctcagttcttcctcagccaccatcatgttgcttccccagtacagaggagaaactcccaagagaaagggtattccagagacctcatctgtgccttccgggatgtttgaggaaatattctctgctcaaaagatatgtatgaagcattatttgagaccttttcaggaatcatctttgtgcctgggagtctccagctgactgccaaggaaatttgctaacaattacacgtgtctaaagcccaatgctttggtgcgagtgaggctatgttcccagtcatggtctctgccatgtttgactgccctaccttgaagaccaagctcctggtgtcagataagtgctatgatgggtggttggatttcaaggagctgattcagtaagtggacattgcaaatgagaaacttaaatcaagaaaatgtctgattttggaagatagaatgttgtatgagaaggtggtgtgagtggttgtaatgagaagcttaatggtaatttctagtcctgaaaaaaaaaacaaaacagagtaactccccaacaccctcaacagaagaatccctgatctggcctacaagttctcagtctgagtgaacgtctcatcttctgattcatacttgaccattcattctgagatggtaaaaaaataggtgataaaaatataaacacattacaaaacataataaaaagcttatatatatacaaaattatataatggaataccattcagtcattaaaaggaatgaaattatgtcttttgcagcaagttggatggaactggaggccattatcttaaatgaaataatagaaatacaaagtcaaatactgcatgttctcacttataagtgggaactaaataatgtgtacacacagatatagagtgtagaataatagacactggagactcgcaaaggtgggaggttttgagagggtgaagaatgataaattacttaatgggtacaatgtacactattttggtgatggttacactaaaagcccagatttcaccattatgtaacaaaactgcacttgtatcccttaaatttatacaaataaaaaaaaacccactggccctgggatatgagaaaatacatattaaaacaacatgatgccatgtttatcctcaggttagccaaatacagtagtctccccttatctgtggttttgttttctgtggtttcagtgacatgtggtcaaccatggtccaaaatagttgagtacagtacgataagatattttgagaaagagagagagatcacattcacacaacttttattacagtatattgttgtaatttttctattttattaattattgttttcaatttcttactgtgcctaatttataaataaaactttatcataagtatgcatgtttaggaaaaaagatagtgtatatagggttcagtaccatttgtggtttcaggcactcactgggggtcttggaacatatcccccagggataaggtgggactactgtattaagtttgataattataaatgccatctttagagagtaatattttagtgtccagagatgtaaaaaaaaaaaccatgaacaagacagacaaagcccctatcctcatggattttatattctagacaacaaaatggacaacaagaaaacacataaatgatcaagataatacagtttccaaaagaaactcccaacaaaaacaggcaaattaaatagagtgatctcatgtggagatgggggaattatcttagatttggtggcttcttaggagaggatgagctgagacttgaatactatagagccagccttttgaatatctgtaggaataatatcagagagaatactaaggtacaggacctgaggtgggaaagagcttgacttgtttgaggaacagaaagaataccagggtgcctgaagtgtggtgagtggaaaagagagtaggaggagaggaggttgaatagcaagggagagcgagattacagcgggtcttgtaggttatgtaggaaatgtctgtggaatgtggaggagaaggacttgatctgagtgacgttttaaaaactccttcaactgctgtctgaacaatgagagacaagacaggtagtaaaggacctggcagaaggccagtgcagtcgtttaagtgagaagccgtgttggtatggaccatgatggtggcagtggacacaggactgggaatttgcaaggcgaataaggaactcgtctcaggcacaaaatgtaaaggggcactgaaaaatccagtgatcaagagaaataatattttaattttcaaatacattttaaaaatcaaattataaaataattttcataattgaagtttaaaaatttgtatataattttacatatttattttatatatttatatcatctgtttataatttataatttcataaattttatgcttttaatacaataatttaatttttttaattaataaaatcatattggcaaacttctgctgacagatcacctgcttctatttttataaatacaatcttattggaaccagagacaacattagggtgaccaagtaaggtgagtcatgcaactgcctggttggattacaggctgtgtgagaactatactttgaagctggcttggctgaatcccattcctaaatcgtattgggtatacttggccactttgggagcattcattgtcatgtacttattttaaattttgtggctgggcacggtggctcacacctgtaaccccagcactttgggaggtcgaggcgggcagatcacttgaggtcaagagttcaagaccagcctggccaacatggtgaaaccccatctctactaaaaatatataaattagctgggtgtgttggcaggtgcctgtagtcccagctacttgggaggttgaggcagaagaattgcttgaactcgggaggcggaggttgcagtgagccgagatcacaccattgcactccagcctggatgacagagcaagactccaacacaaaaataaataaattaattaatttaattaaatttggatattttattattaatttttgacagttttgattattttaaaaatatttcactaaaatattatttatcttgactactgaatttgctggtatccccttaaatatcatgtctgtcacaaatgtttcacttgctccaccttagtcccagccctgagtacagataatgaagagagacagacttgtgacacgttgtagaggtaaagttgtcagggcttgccagtggttaggatgtggcatagatagctgggtagataagtagatacatagggaaagactgataataaggattactacagatttttgccttgagcaattgagtaaatagagggtattttactgagaaaaataaggctggaacataaaggcatcatatattacttatccaacagaaattaatgcaaaaaaattaagggaaaaaatggcagctgcacctctaacaaatcatcacccaatataccaagatactagctgttattttaaaaaatcaaagattaccaaaccaggagcctaggctctaagtcagagaacctaaatttagaaccttgctgttgcatcttttgcaatttacagagttgtacctccaaagcagaccttcatggggaccaaaagtcaacatccaatggctatattcttcaccaaagggacaatgggagtttccaaactggccgagtattcccagtatgatttgggaatggatttcagccagccttccagatatagtcctcacacaccctattcaggcttgaaagctcttctctggagtggtaaagggagagtttcatgagactaaagctaaaaaaaagagttcgttactcaagattgcagaaaacatcaatattgagagaaggaacagggctgaaagcagggtgggagggtgtacaccaaaggatcgaaagtagattactatagatcaaaaatctaagagtacacggtaaaaagaggaagagcagtgaatccatgcagttgaggagggatccaggatgattatcccaaagacgcaccgttggatgttacttgttcttcagtgctaccagcaccggggtgaataattgtgttgacccctatatgtagtgataaacacagagatagagtcacaatttatgagggtttggggttctagagtcagattctaagatgagaatcacatgtcatcacactaccccttaaaaaaattatttaagtagctcacgaatacttttgggcatgagtcactgggccaatgctaatgcctctttctagcatcagtaaaattgccacaattttactggcaatatccaggcttattaatcaaagcaacaatgatcaaaacaaggcttctggggttcagaagtaaacgtctctcttggcaaattcaagggatgctgaaactgatttcaatctctttggttgaacactcaattaagtaattaattgggttgcatttgttttagtttggtttgtctgtggttaagtttctcaaccttacattcaattctgcctaagataaatggttgtgtgttgtgactccacactcaagttctcttaacaaactctactcaaagcttccttaggggaaacaggtgtatgtgatgttcatactcacctcaaaggctttgactctcataagctataatggccagtggatatcaggtagagaattagaacaggagaaactattctaactcatttattaaaatggtttaggagatcattcatttattcaattaattaattaataaaagtgcttactagaacacttcagagacccctgaaagccatgaatcctggaaggcaatatcataccaattaagtgatactcacagaatttaaggagactccattagcctcctggcctcatagcctttgtttgttttcatttgggtggtccttgtttctctccacagattagtacttgataatagcaagtattattgttgttgctagtaccaacatgagaaaatccaaatggctttcctattcctctttagatggtggatggatctccagccaacaaatattttttggtgtaagtgatgcctttgatggatctttaagtactgccttgggagctcagctccaaggagcctgtgtgtttctgtgtcacatgccaattttctgtcccgagactgttctaaatgtaagaccaggtccttgttgtgggacatgtggggcagaggccagaaagaggcattagcaatggctcagtggctcatgccccaaatggggcaaatcaagaattaaattcggaatgtgatcttgacttaaagatgctctccctacttctgagagcaatgccccctcacttctctagggcctttggaattaggaggacttggctacttcagttgtagcactcaaaagaaagcttttttttttttttttttttttgagacagagtcttgctctgtcacccaggctggagtgcaatggcgtgatctcagctcactgcaacctcccgcttcccgggttcaagcgattctcctgcctcagcctcccgagtagctgggattgcaggtgcccgccaccacgcccagctaatttttgtatttttactagagacagactttcaccatgttgaccaggctggtcttgaactcctgacctccggtgatccacccaccttggcctcccaaagtgctggggttacaggtgtgagccaccgtgcctggcctgaaaagaaaacttttaaaggacaataatgacattgaagaagacaatattaatatcagttactattcattgactatccactggtacttcatatgcattatttcatttcatctctccaacaaccctgtaagggaaaaactggggaaactgagtctcatagaagataagtacctagtccaaggaatcacagaggtggaattagacattaagcaatcatggtctattggactccacagcacaatctctaaactgttgtgctaacctcttaagtgcctccacaatccacaattttactggcaatatccaggcttattattcaaagcaacaaagatcaaaacaaggcttctgggatccagaagtaaatgcctcattgtgtatctattcagatatcagtgaataacatgatagctgctaggttcacacagctaaagctaaattatctcccaaggtctggagggtgaggaatcactaaatctccaagacaaatggcatgacccagccgagtctcaaagttagtggccttccctggaccttcccccgccacggtctcaactgtctttcctacttaacatatagatttggttttttcttccttggggtcccaggctctgtccaggtcttccgtcaccactctatctgcaaatccactgatgtaccaggaactgcttcagcacaagtgtttcgccaggtaagagaggatctttcaggagagagtccatttccactcacggtatcataaataagattaggaatcctcagtttgttgaagtagatccaatcctatctttcattaacacacctatcttgttgccatttatgacaataacttcattagagtgtgggatttttttattctcttgtgacttttcaaagccgtatcttctggctccacaggagtccagaatatagaactaaattataatcataaggttgagtttgtttaatcaatttgtaattacacctccctttaaaaagataaacattaaagacaaatacattacctataaataaggtaaatattaaaaacaaagaccaccttccttattggatataaatccttttaggccttttaaaaataaatttatatttatctacccatcttcattgcaatatactgaaatattgggatgggattatatagatggtatcatactatgtatatcatagtaaaacctgcattttcactccacactgttccttagagctctatttatgataatatgtgtaatatattttaatcattgcatagtattccttagtatgaatgaattatatgttaatgagccccaagtacctatcaaggatactcgaatcttttccaagctgctgaaataagaatctttgcacatatcctagaattctctagagtaaccactgagaagtggaactgccaatgttttgtggagtctgggtgatgcccagattaatcatcactaaagattaatgagaaagcacaggttccaaagcattgtatcatgccttagagtttgctaaataattatttaactctaaattttactttagctgtgtgagcaaggacatatactctctgaagggagcatttgtgggaggaaagaatagcaacgtattaaattatgatgacataaatgcctagttcattggcattttatggagcaattaaaaataattaagttaaaatacagtatatctttattcatcaacatgccatcccatataaaatgttcagattctttctttcttttttttgagacagggacctgctctgttgcccaggctgctgaggtgctcaagggatcctcccatctcagcctcccaagtaactgggactacaggcacatgccaccacacctggatgttttttgttttcattttttctagagacctggcctcactatgttgcctggtcttgaactcctgggctcaagcaagtctcccacctctgcttcccaaaatgctgggattacagtcatgaactactgtgcccagacagattatttcttatactcttgatagaaaaggacttaaaattttacaaatagtcaactctcacttgtacccttaaattaataataaaaaggcaatgataaaatggtgcctttggaattaactcagaaacagttctccaattctgatctttcttagtctcaagacctaactcggtgggcaggtcaggtattatctaatacagatgagctaccacataacaattaattgacactcttgtgttcaaaatacatagtcattctatctctatctgagaccatgaagaggtttgctctaatcatcttcccacactggacccttctaccatcaccaaaataaaatacacataaaatgaattgtgggtttataaaaagtgttcgctactatttatctatgtctggggccctatggaaacttctcatatatccagagactttcagcccagtttgtaaaattggtggctgtctctccatccccagacttcagaaaattagttccttctttaccttaccattgctgacacattcttcatgcacaggtaaggtttttggggtgataatagaactcagaagggtttctacagaaggctggcttcctaccatcagttaatacttacttacttttagcattaatacttcttgtccagaagagtaaatgaatcttcatagagactgatgtaactgagatgtctgaatagattatctaaaagactagtaataagaacataaactaccacttaatgagtacctcctatatgtttggcaatatctgtatcatttttgcaagtttctttctcacaacagacctgttattggtagaaatattcactaaggctaagaacaacttttgatgcctctccagctacagattcaagagtctgaagctttgtgtgtctgtaggaggatccatcagccctggggtgattgaggactggaaacacatcactaaattgaacatctatgaaggctatgggaagacagcaactgtaggttgatgctgattcaccattcagccagaaaccaaacttgtccattcactgtgtaagcacattgtcaaatcactagcacacactagaaatgcagaactggatatgaagcacgggaaaaggaattgctttaatctaaagggaccccccttccattgcaagacaaagaattacaagtacagataacttataaacttacagatttcacagcaggaagttgagctagtttccacctgacaattcctgtttactctgtgaagtatgaggcaatgtcacctgacgagaatgtgaaaatgatgtgatagaattctgagtggaggatgtttaaaatgatcattgctgaatatggaagaaagagcagattgcgaaaataaaggagaaatgggtaattataagatcacatttgaggttgctgagcattcattttcaaagtcactaatctatgtagttatgtgattttctccaatatcactctaaaatacagatataagcatagtgaaagtaaacagttggattgaagcaggattaaagttgtgccaagaagatccaataaaagggcagtgggcaagggatctagtgatattggaaagaaaatagttaagatgaaagactaagaaactaagctgactggggaaggaagagaattcaagaaaaggcagataagttgtgtgaaggcaaagcactggggatgtcaatggagctggaatgactgaaggtagttgttttaggctgctgtaacaaaatatcatagattgggtggcttaaacaaccaaaatttattttactcacagttgtagatgctggatgtccaagatcagagtgccagcatggtcaggttctggggagggccctcttctgagttgcagactattaacctctggtggtattctcacatgacagagaaagagagagagagagcaaaaagtctctttctctgttttgttgttgttactttttttttttcttaagagttagggtcttgctctattgcctaaactggagtgcagtgatgcagtcatagctccctacagcctcaaactcctgggctcaagtgattctccaacctcagcctcccaagcagctgggactacaggtacacaccaccacacttggctaattatttatatattttttagtagagacagggtcttactatgttgcccaggctggtctcaaactcctggcctcaagtgatcctcctgcctcagcctcccagagtatttaggacaggcacgagtcaccgtgcccagtgtctcttcttatgagggcaggaatcccatcatgagggcatcactcacatgacctcatctaaacccaattacctcccaaaagccccatctcaaaataccattacagtgaggagaagggctttagcacatggatttgggagagatacaatttagtccatagcagcagtggtcaaacagtgagatacatagacttaagatttcagaggtagaacatttgcaggtgatgctaacacaagagtatagccacaggtggattaagtgtcatgacactccctagagatcagggtcaataaatgaagagaccagagggtagaacttgtcattcatatagatgtaggaggcactcaggatgatggtgggacgtggagtaaaggaaagatcatgaacctcgtgatgaaggctttaatggataaggaatgactgggagattggtaaattatagcaaccaggagtagtagagggtggtaaaggtaagtggtgtgagtcttagaaagacaggggcattgtacatagggtcagaaaagtaatggttaggagtaatcatctcttatgttttaaaatattagacaaaatgtgagactggtgatattttgactagaagtcacatgacctagattctaacacaactctgctacagaacaactgaaggagtcgtaagagggccctctgtctttctctgtgcctggtttctgattcattcattcactcacccattccatgaacacttatggaaagcccacattctcctaagcatggggacatcgtgataagcaaagccacaacaaccttcacagggctgtagagtagcagagcagatttaatcaaagaattgtgtagtagaagtatagccaataccagaaataagtgatctgaagtgaaggaccagaactcattgaaggtatattacaaagaacctaacttcttttacggaattaagaaaatcttccctaagaaattcctgttctgagagctgaaggataaataagggttcaccaggtaggggacggggcatcttgggtggaagagatcaggttgcactagagaaaccctctgagggttcatgcacagactacagagggtcagggggctgggatgcaggagtcactggagaggtggggaccatccagaccttccaagtcctttagagccaatacagctcatggtcacccaatgttcgtcctgccttctctctcatgataagacaataagctgaatgtgcaatgaatcagtcaaggtagaaaagctaaacaagttgccaaggtcacacagctacttgctttaaaatattttaagtgagatatgattcatatattataaaattcaccattttaagtatatacctgagtggtttttagtatatttgtaaggttccaaaaccatcaatagaagcccttgtttttaggcactacttactttggcctcttttaacctccagaagagatcatttacatatatatatatataattttacattttaaatatatattgtttaatattttatatctattaagtatattatatattgtttaatattttatatttattaaatatatataatacatataatatttatgtgtttaagtgtggcaaaacattcacacaataaagcgcatgactttttttttcttcaacttttattttaagttcagaagtacatgtgcaggatgtgcaggttcattacataggtaaacttgtgccatggtgatttgctgcacggatcatcccatcacctaggtattaagcctggcatccattagctattcttcctgatgctctctcgcctgccacaccttcctctgacagcctctactgtgtgttgttccctcccatgtgtccatgtgttctcgtcactcagctcccacttataagtgagaatatgtagtgtttggttttctgttccttcattagtttgctgaggataatgtcttccaactccatccatgtccctgcaaagggcatgatctcattccttttaatggctacatggtgtatatgtacaacattttctttatccagtctgtcattgatggtgcttaggttgattccatgtctttgctattgtgaatagtgctgcaatgaacatacacatgcatgtatctttataacagaatgatttaaattcctttgggtatacacccagtagcgagattgctggatcaaatggtatttctgtctctaggtctttgaggaattgtcacactgtcttccacaatggttgaactaacttacactcccaccaacagtgtaaaagtggacctaaactataccctacaataaatggacttaacagatatttacagaacattctacccaacagctgcagaatatacattctattcatcagaacatggaacattctccaagatagaccatatgataggccacaaaacaagtctcagtaaatttaagaaaatcgaaattatataaaatactctctcagaccacagtggaatgaaattagaaatgaactataaaaggaaccctcaaaaccacagaaatacatggaaattaaataacctgctcccgaatgatcattgggtcaaaaatgaaatcaagatggaaattaaaaaattctttgaacaataatagtgatacaacctatcccctcacctgggcctttgctccctgctctctctttctctgcttctctctgcttcctccttttcccctcctttctctctctctgcccttcccgctaccccctttctcttccccacccccattctctctctgcctgttcctttctcttacaaacctcaccccctacactctgtgttcctttccagccctgttcagagggagcctctcacgactgacctctgcacatcccacaatttgaaaattatagaaagatggtgagggggacacaaaacttattgagaaatgtctgctctccgctcagcttctgtcagacctacctgcatttggtgctactaggggcagctggttcagtggggatagggctctgacaaaccctgagcttctgcagggtctcatcactggctccacagccactgctggtccctcttctattccctattaagataaatcagccacctcatggggatacattcctgtccatcttatcacaaggaacccctgtgactggcaggcatcaggtgcccaatgactatttctaaaatgaatgagcacaatctccactcatggcttgatgcgggacatttccccaccccagaaagcccccttggggccctcccagtcgacactacccaaagggcaaccctgcttctgcagccagcactgcaatatctgcctgggtttgaacagtgtatgaggaatcatacctggtacaccggggggtcatctggtcctccagaaaacagacgcccaaacagataggactgcaaacctttattaggggaaacactacagaagattagagacagatgaggcagcactgggcaggcagcgtaaaatgtattggatacttttccaagttatgtaggagccacagcatggctgtcacagctcaggggcctcttcaaatttcagcttgtcctttaaagcaaaaaaaaaaaaaaaattatttccatgtgatcttcttttgtcttatatacactttgtcttctataaaatatctgtgcccctgataaatacttctgtgtgtggctgcatctgtgtctatatgccatggaaagcaattatctatgggtctcaggtataggtcttacagtttaactgtgtacacattcttataattatcttttcttttatctggtagaatctgaattttaatcgtggagacaggggctttgccttatcttttgaaacagggattggaaatctctgggcctgagctattacagcctatggtttatctaatgaacttcaatgaacatcttttgatgatcttctgagtgggaatattttcatttaaacagtgagggggtgagtgtctaacatctgtcagctattttggaaaatgcttcctttatgggcttggtctctttgtcctcacaatgacctcataaaccacatcatccccagctcatttataagaaagctgaggccctgagctccactgaaagttggtatctgggctcagacagcagggacagagggaagggtgacaattttgcatgacaatgttggagatgcaaagctgggagtcagaggtgagaagcagagggtgccaggaatgagctgagacccgacctgccagggcagctcaggattggccttcagttccccagcagagtcggtttcattctgaaggccaaggccgcagctccactgaaccactgttagtctccttgagccataataaactcaggcagatagggtccccttatagaaccaagttaaatttcccagacctctaggcattcattcaccctgatccagagccttcacacatccagggaaagaatcatccttcccgcagataatggactaaaggctttagggcaacaagcaacttctgggaaagataattctcttgtctacactgtgccatctgagctctcccatagtggctctgttgtggccctcacgcagccgccacgctcctgctcacactgcttgcgcctgccagaagtggccttccagctccacctaagtgagttcaacaaacccccatgtgacatctcccaactttatctctcttccatgccctcctctttattcccaggagaatctgtcttcctcttttgcattctggggcccttcactcgtgcttccattatggatggtcacaagatccctgccctttggtgtgtgtctctctgctgtaggacataggaagcgctgcaggtcaagggtgcgtctcatccctcacagagctggccacatggtccaggttccatacatgcctgcaaaattggtatttatggcttctataagcaatctctttcctcatctacaagagatacctgctgccttgcttgtgatggggagatgatgcaacccactttgtgccctcagaaacttgagaaaagtaaccacgtcactgagtgcggtggctcacgtctgtaatcccagcactttgggaggctgaggccggcagatcatctgaggtcaggagtttgagaccagcctgaccaacatggagaaaccccgtctctactaaaaatacaaaaaaattagcccagcatggtggcacatgcctgtaatcccagctacttgggaggctgaggcaggagaatctcttgaacctgggaggtggaggttttggtgagccaagattgcgccattgcactccagcctgggcaacaagagtgaaactctgtctcaaaaataaataaataaataaataaaatagccatgtccccagccagtgttaccctcgtattgcaaagtcctgcagtaccatctgtgacatttctttctactcattcaatgaggagaaaaaagatgaatccgctttaaaagtcagtccatacttttcagatcaacataccaagtggtgtgcatggaggcagtggtcgtgttcccagaggccacccaggcagaggaggtgtctggcagcccacaaatggtcctgaagagccagccatgcagtagagcaagtagggcaatcctgaaaaaggggccctcccaaagccatattgacctgcagagcagaaggaagaaaagtttcaaaatgcattaatatgatggacaaaaacaccaacaccaacaccaaccccatgcagcaggtgacagtccctggcacctttctttcctccagatttcaaaatagcagtgtcagtgccaaaaaatctcccttctactgagtcctgaggacagctggggtgtgaagggaagccatgaggataacctgctgtcaccacatgccactgtgtctgtctgcaaatgcaggcactctgggtcctgttccagggaagacagagccattacacagtaataaaaaagcatattccagacacatgagtgtccagcccaggtatactcccatccctccctcaccaccatcactgaagttggttccttgcatatgatgaacagaaagaaaaggaggaatgaaaagtccattattcatacaagaatcacagctactcttgggagaactttgtataggccttttatgtcctatctctgattctcagaatgctgcaaggtcagtgtggccactctgcactaaatcgaaagaaagaggatcccagaggaaggagagaatttacccagggtcacacagcttgcaagaggcagagtggaaattgatcccatctctacctgtaagaccctcttgtccccctctgcctcccttcctgacaaagggtcttctctactctggaggtacaacctgtgggcacaaaaagctctggggagatatgaattactgaggtcctgcaggggaactgggaaaggattttctgatagaacaatctaatctatagaagtcagttaggcacagctataatatttattttaactcacaggtattaccaaattttaaatgcactatgacataaagaacaattttgtccatggaaaaatgagatgggagttctaaataacagaattaaaacaaccgtgacttaatttcaagtgcagaaatcctgtcatgtgtgatcggaggactcaccagctgtgaaagctacagggaccacatgagaaacagcttagctgaccataatttaaggcctttgttgggaattgtccttgtaggtaattagtgactttcactcttcactatctcacatccagtgtacattttctattacaaatataaaacctctgacaactagaatgttcgatcaagggcaccactggatggagacggggcatttttgcatagcaaagttgccaagagagatgggacagtgatgaattatggaatttgctttgtcaaagagcattcagaattgcacaaaacacatattaatactggatgaatgagttttcatatttttcacttatgggggttacagcagatattctaaaagttagtcacctaccccatagaattaaataacagcaacaaaatatccccatatatttggggaggggacccagcaacatcttgagtaaaaaggatcagtcagggtctactgggccatgagaccgatagcagtggagttaagtggcatcttctcatgttatttctggaaatagaacagttaaagctcttcagcctttggcccttaagcatttatggtctctggaagtgccaccaaagatgaccagctgggaatggagaagactgaagcctcgtggagaatattttgctttttaaaaagtaaagagacagaaaagttaccacagaacacacaaaccagagacaaggccaggagagggtgctatatgaaaagacaaaagtgtcctgaaataggcacagtgaaaatgaccacagcatttacctttatctcctctgtgctctcagttgggatgcagctgctgttcctcatgggaaccaaataaggtcctgaatctgctaagggccagagaagggatcggggcttattctggcttgcatgttctttgcagaataagaatccctccatgtccacctctgccatgtcactgtctttgtcacagtcaggtcccttaccagagttacagactttattaaccagatgccacagaggaccctggaactctctggacccttgtccttgagaaggacaccacagagccctggtcttaacaaatcaactaactgcgaacaggtaggtctcgaactagctggaaatcaactgtaaatcagaagttcccagtgcatatcagagggaactacttataaattaagcacagactaaaaattaaaataggagcattcaaggataaaaagaatatcaataaaccctggacaggaatagcactgctcctttttttcaagccatagagacattcacaattctttggattcatatttaatctaacttccatatcagaccaggtattataaatattaatgaacagaaataacttaaagagactaacagtaatgagaaaaggtaagaactatgggaattaactgtaaagttttagggttacacttaaaatgttagaggagtaaaactgcatagaaatttattactaatggaattgtatagttcacaataaacaatttaaacaaacaaaaataataaaggatgctccaaaaatagtaaataaatgcctcttttcctaaaacatatctcattgtacaatattgattcatgaagacatagcaataaaatttcctctctcattaggacatacagttccaattctaaaatgttattggtgttgcttttatcaaatgaaagaaaaataaagccttcactctgacgcaaggtgagaagtggagctggctcatttcccttctaggctcatcacctctgttaaaagtaaccaaaagctcaggatggggtggtgtccacagtcagtggaggggactgagctccaccattcatgggggactggacgagagccatttgtctggggcatttgaggaaaattgtgtcctgacacccagtgagacaactgctctctttagtaagtgcttgaaactctttccaggaaacataacaattaccctccaccctgacccctcacccccaaaaggagaagcagagtgtgtggattgtacagcagaagttacatggctgccttcacagtgagctcctacctctttggggatgattctctatgcctggttgtccactagctggctcctgactaatgtgtctctccagcactctctgtttttcaatcatttcctatcttggagatagagaaagaatgaacttaaataagaattaaaacaccaagttctttactagatactcaaagctttgtcttaaaacaaaaacatccttagaaatgtccatcacaattacctacctgtgctgcttgtaggcagccttcttctcttgcatctccctctgcgaggcttaaacacagagctgtgggggagaaaaatacatccacgtcctgacctggcagattatgtccaaaagcaaggaaagaaaaaaaaaaaacttacccagttgtcgtaagcctttctttcagaagtggcgatctgaaaaagccaacacatgagaaaccatatgtttaaggagtctaagggccatgagatcatttgcatcagcgctgaaggattctgcaactgctgggaagaaggctccttacctggcatctgtagtagtcttctacccaattctgctgctcttctgtgtcttccatcattttcctatggtttagaatcacttttatcaggtaaagtgccattttaagtatgattttaaataaactgccatgttcctgttatcctcacaactgtacccttacacaatctatccatagatagaaaacgcattccacatggttataaaaatacagtactataaaaaactgttgctatattgattccttatctattatttaatgcctgctgggttctgagttggcaatttccttacctactctcagtatgtccttaatttatccttcattgagcatcacttatcataaatctctattctccttgtactaatatccttaccatatttcacagggaagaacaactgggcttataaacaggcacagtcctttttaaggatgtgattgatcctacaacaatgcactttcctaaggatgatgacaatcatccctagaaaagtttgcgtaaactgagtttcaacacagtctgcccagcattggagtcaggaaacgttttattacttcacagtttttggtcactggtaaatctctttttttttttttttttttttttttgagacggagtcttgctctgttgcccaaggctagagtgcagtggtgcgatctcgcctcactacaagctctgcctccgggattcatgccattcttctgcctcagcctcctgagtagctgggaccacaggcgcccgccaccacgcccggctaattttttgtatttttagtagagacggggtttcaccatgttagccaggatggtctcaatctcctgacctcatgatccgcccgcctcggcctcccaaagtgctgggaatacaggcatgagccactgcgcctggccagtcattggtaaatcttaaagtactttgttttctcttgtgtgaattttctctctctctcaatatgtcttctgaccatttgtttatctttctgtgttaattgggtataaacattgtacaaaggttaaaaacaaaatactccaacaggggtttcccaagaggttggtattgagtctctgaagtcacttgtaggtgtgtatttcctcaattactaatttcaagcttccctgcgcctctgacaactgcctctcctttgctgctcgctcacgttctttcatctcagcttcctgagatgagaaaggaaagaaatgtatgcacatgatccagtagccagtgtgggattctttcttcccttccagcatctgaagactgtgattaaaaggtcctttgccaatcttcccatatatataccaacagatcttcataatgagagggagaatggaagcctcccattgagggacaaaaaaaaaaaaaaaaattcacactctggcctgctggcaagtcctctgtaatttccagctcctcttcatagctctatactcctactcactagtaagtaaatcaaggactataaaaagcttctatgagatgcactatgtgtccttctggggtcagtcttgtgcttgacacagtgaaagctcattttagttcaatgtggaaaaccagacctgaccaactcatcacaactaaatcaatcaggatggagcagaggatcattctttgtctgactcctcccatggggagacctgattctcagtcagaggctggtgccagaacccagacaatcagccttagagagatccttccaggatatggtgtcattaaccctgtagttcaccactgcacgtttccatgattcagaattggaactcttgtcatcgacttcaaagattctggttgacagaaaaggtaaatctgagtgctgggcacatctactgaatcaaaaataatctgagtggctccttagtcagggtgttatgtcctggaaataggtgataactgcaaaccatcaaccctggtgttgatcgagtttaacaaggttcagttcatcgatagtggaggcagaaaatggcaatagcctaaaaagataggtttgctgtgttgccctcacactacttcattcacgactctgattcaaaggatctcatttgagaattgatttcatatgaaggacacgtaaaattcgccaaactttaggaaacagggacaaagacactttaaagagaaagtgaatgcacttgtttctgaatacctaagccatccttcagcacatgctgtctggagtagcccaaagcaaggagtttgttgtgaggtactgatgatgcaaggggagcagggacttgttcccaccctaaaggagctcacagtttaatgcaaatgagaagccagtgagaacatcattacccctgctgtgctcttgagaactaggaacacaaaacatgaatcttaagaaaagcaaaggagaagttctgcttttgagtggggatgagtgcatctgaagcttctgatctcccacgagaacaatggagaacaccagacagaatataaaacacatgattgaatgcatccaattgctaacatggcattaaaggacatgaggacaagatggataagaaaacctaggacaaaggtcagcccagcattcggggcccatttccctgagtttcactgcttaattccagaagggactactgagatgtaaagaagcagagcaccctttgcacactgcatgggattggatggaaaacaagtggagttgagggtcttccattgaaggtgacccctactaaagtccagtagctttggttgggacccagaagagtcacacgctaggaataaaggtggacaggaaatacatttgcctttataaggactgagccttcactgatgacctcaattgctgactggataaagggagtccaggtctgctagtacccctgaccattcaccagaagtagactcccattttttctgcaggataacatccaactaggcctcagtttgtttctgaatattttttacagtgtctcacatttaataaaaaatgattagccatatggcaggaaaaatgcaatgtaatatgaccaaaacctaaaggactatgaaaatagatctaaaggtgacccaggtattcaatgtaaagacgtcagtaccagttcctcctcttctacctaatcaattacaaacaagaatgtatgaagggaaaggaaatatgcagattacagaaatcatggcaggaaggacaagcacaattttctaaagacttaatttgccacaaatattgcataaaatattttaaaggaaattataattgtctcctttggttgacacatggttcatacaacagcatttgtgtcaatgaacacattgacatcttactcttcctcagtagtcgttctttgtctgtagattttgtaaacactatctactttcatcttcatcttttttatttcaggttgcacttctgcttccatagaacttcgtgaagcaaagaggactttctggtcatttttcattcctggaaaggataaaaccattttctttgtgtgcatgcatgtgtacctgagaccttggttagggtggggagaggagaaggtgagaaatctgaaggcaggaagctgttcttcaccatcccagggcaaactcatttccatgctatcgggactccatcaaatagtaaaccttccagcttatgattattggacctccagggtctcagctgtaaatctttgaatctgtcatttacattttgtgactttaagacagatttgagaaaagacatttaagaaataataattgtacaacaacatgaatatacttaacacaactgaactgtacactaaaacatggttaagatggtaattattatgttatgaatattttaccacaggtaaaaatgtttaacaatttgaaaagcaagtaattatacttagctctctgagttctataatttgtaacatttcaccacctgctccttcttgatcttcagcggagtacctcccttctgtccctgccctacttcagattccactttcccttccctgacaccaccttcattaaggccagtttgaacctgatgcgaaatattctcactaatgacttaatttccacaaacaaagaattccatgtggatatcatatgattttaatcttctaagacatgaaatatttgttctcctcatagctaagatgcaatgaaagtcttgtggcagatgtgggtcatttacctctgaaattcctgaggtattcattgaaataacatctttcaagttctttgtagaattttgtttccaacttttgcatataggatagaagcaaaacatgtaccaggatttcagtagatgcaccaaatggtctgctaaaaagatgaaacagcaaccatgcctatcccacagctactgctatatttcatggggaagtagctggcccagtatgaggataggagaaatgttgagcacatttataaatgaagagcaaagaaacaccatgaggcatgaacattttgtggcacccatgatattcctgcttacaagataatgggataagtgagtagatgacaaggagaaagtagagacaatgcgaaattgttcaagtcaaacagctcaactgaacttttcttaatggaatatttaaaaagaggcacgtaaagaaaaacttcccccaattcacactgaaacattctctgttcagcactaagtggggtagggactgttcaatgtgcctagatatcttcatcactcatatattttctgttttctgtatatcttgaagggcagtgccaaataatgtgacaattacctatattgtaaaaataaaacacacttcctattccctttaatataaaaagtcattgtggtattagtacttttattccaggtcattgttcagaagaaggttcagcccccagacacccacacttttactgtggcgggcagcaagataaaatgtagagctcaattcacccaatggacaaaaaggctcaaaagccaaattgaatcatggtacaatttagcagccaaattcttatcaagttcagacttttgacatgctgatccctctcaattgcaactgggaacatgtactttgaatgacatcattcaaaatgttatttttccttcaaagtttttgatgttatccttcaataaaacatatgaaatcattaacaattattcattactcttctttctgtttttagactgtaatccaggcaaaaacaagggattttaccttatacttaagcatttcatcagagagaatcttgtgttgtttcttagtttcttgaggatgtttctttgatccactgatctatataaatatgtaataaaaaccagaatttaaaaatattatactgctagaaaaacctatcttgaactatgtaactcctaacacaaatgaaaacaacagtactttacatatatgaagcttactttgaatgtggacagtttatagaccatatgaactaggacactaagtgaaaggggaaggaccaaaataacagaattgtgggaggtgggagctatttaaagtgaaaccatgaaaaattaaaaaattgaaaagacaatgatactttctgttcccaaatgtatatttcttctacaagttctgacttttccttcttgacattaatcttctcagaaactggttgtaaattaactaaaagaagataaaaacaatctctaagattaggaaaacctcataaaattgaattaccctaatgtattagctgcaatcacacactatctggcactatgatcataaaataactttttttagctttattattgcacttgaagatagcaagttagttaattgctttttgagcctaagaaaagaaatatgaaaataacaaccctatttcaatgagaatcctatttgataattttccaaatattgggaaacatttagtctttgcctaattgctctccatcaatagccactattcttcttggaaaattccatcagttcaaacagttttaccatcatcagagatgaaacacagtgaaaattaaatatcctatctataactcttctgtcctctaattatcaaggcaaataaataggtcccttcaaaaaagcccctcattttggcaggcttgattcacttccagtcactctttgcaattccatagaaggaacattcaaagtatcaactgattggctattcaaaagcctccagtgttctcctgctgcccagcaggctgtccttcttgagaaccagtgcaggggcttctgtgacgtggtgtatgaaatccaacaagcttaggtacaatctcaggtttaccacttagtctctccaggatctggatgattcacaagccctctaagacaagcctttcatgcccaggatgagaatgtcaccacccaccatagacatcaacagcatgcaggaagctcccatcctataggtggaacataaaacacttggcacacagcccacaattccagaccccactgccaggcatttaatcctctcatctgaccccaaagtgcaatcttcttttctatttgcccattgtaagagctttgctgccttgaggtccctcttctcaatactaccaacgttgtaatcactgtaaccaaccctagcctctgagggcctactatgtgccagacagtgcagctctcaacagacagcaacaggtaatcttcacagtctatgaagaatgtgcagaattcattctccacattgtacatcaaattcatttccacatattctacattggcattaatggccctcttcacttaacactcaaaacacatgttataaacctctaatatgatacacattttgttcagcaatatctggatttttctctaggctcaggtagtgtcttaatcatctttccatttctccaagagccaggtcatgcaaaagtattcctgccacacttcaaattcatatcagcacttgcttcttaaatattgctgtgataagctaaactcatcctattctctctactcttatgatctcttcctcctcctactctcttatctcaataaatggtaactccatctatgttgtcatttagactttaacccaggaagagtaaaattttcaagaagtaagaagtcaaccggatcaaccggatataaggattcattgtatttactcccagttgaatttgagcccacatgaaatactagtgtgagaaaatattgaaaagaaatagacacggccgagcacagtggctcacacctgtaatcccagcactttgggaggccaaggtgggcaggtcacgaggtcaggagattgagaccatcctggctaacacagtgaaacgccatctctactaaaaatacgaaaaaaaaattagctgggcatggtggtgggtgcctgtagtcccagctacttgggaggctgaggcaggagaatgatgtgaaccccaggaggcagagcttgcagtgagccgagatcatgccactgcattccagcctgggcgacagagagactccgtctaaaaaaaaaaaaaaaaaaaaaaaagaaaagaaatagatacctaaaaatcttaccttgatatactgaaggccttatctgcaacaagaagaaagaaaatcaaattttatatcaaatcatattaagaaatatttatagttcttgataaaatagcaaaacttgtaatccaatgaaattataataatcatttagttcaacataataacttcatagtgttgactctcagaagacaatactccagaagatgatgctttggcatactcacggcttcgaattagtggagattgtaaggcctcagaaataagcctcagaacccaaggtctccttctgaacttctcctacccactatattgctgatccgtcctggaatctctaagaggggctttttctgaagtttctttatctaattaatggaagttcctccagaagaaatataattgtcttaaaattccctcctaggaatttcatgaagtaaccatgaaagattaatcactggagaagagaaaaaattaaaagtcattaccttgcctagacatacttttcatttattcttcagagagcagttccaagagattacctgggactttatctgcatcataagacaacctttgttcaaagtgccgttctgcccctcaccttcttgcaacttgtcaccacctccctcacatctcagaggaactttgtcccaggccaattgtttgttgcttgggctgtttcacttcccctaaaaatcatttactgcccctctaaattgcctacgtctccatctccctttccccagtgaagagggtgctgtttaagctttaaccttctggcccttcttgcagtctcacattttgtatggctctcatgtttatgcctgttaataagtttgtatggtttatcttatcctcttaagctgtgtattgtcagttcatgtctgcagtgaacctttggagaggagagtggaagctttccttgcacccatacaatagaaatataattcagaaaggtttagaaaggatttcctatttaagtggtgacacttcataatctatatctgataaagagcgcaaaggtaaaaaacttatttttgaccaaaagatctgtttgcattctcttaaacaaacacctatctatttaatttttataatgtaaatggttgtcataattatcatgctaataaatcatttacctgatttttgtgaaactcaatattcataatgaagtccaaaaccatgaattgttttaaataatttctttttatttatgattaagagtatatctctacagtaagttcatatactcacaccaaggatagttctccgaaagaaaatggcaaatgtagaaattctcaggaaggcagcaataattattggtttcccagcttagatccagctgggaacaagctacataagcaaaaaactccatggctcaaacagttacacaatttgcagctaccaaagaaaaaagtgattattctctcctcagtcagttgctacgagtaacacgtctgcacagcatatcagaaggatagaagagagcaagagcccccccacacagtctctcacacatgcatcctctgcagatgttaaaaaatctccatggattagatgctcatattagtaagaatttgagaaacagcagaaatgaaggaccatggcaaaaaaaggaagattaaaacaagcaaggagatttcttccttctaacctttcatcaacacataaaatttaacatactatcttactttgcacaatgaaaatgagaacataatccccaatttcacaattatcagttataaagaactagacattaaatatttctgaaagtagctgaataaaatgtcaactattagatcacatttgcaaagtaatccactaaaatttatttatttacttatttatttattttttttcttttattatactttaagttttagggtacatgtgcacaacgtggaggttagttacatatgtatacatgtgccatgctggtgcgctgcacccattaactcgtcatttagcattaggtatatctcccgatgctatccctcccccctcccccaccccacaacagtccccagagtgtgatattccccttcctgtgtccatgtgatctcattgttcaattcccacctatgagtgagaacatgcggtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtcttcgctattgtgaataatgccgcaataaacatacgtgtccatgtgtctttatagcagcatgatttatagtcctttgggtatatacccagtaatgggatggctgggtcaaatggtatttctagttctagatccctgaggaatcgccacactgacttccacaatggttgagctagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcacccgctttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgtccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttacttctgagggctctgttctgttccattgatctatatctctgttttggtaccagtaccatgctgttttggttactgtagccttgtagtatagtttgaagtcaggtagtgtgatgcctccagctttgttcttttggttaaggattgacttggcaatgcgggctcttttttgattccatatgaactttaaagtagttttttccaattctgtgaagaaagtcattggtagcttgatggggacggcattgagtctataaattaccttgggcagtatggccattttcacgatattgactcttcctacccatgagcacggaatattcttccatttgtttgtatcctcttttatttccttgagcagtggtttgtagttctccttgaagaggtccttcatatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaactgccaacactatgttgaataggagtggtgagagagggcatccctgtcttgcgccagttttcaaagggaacgcttccagtttttgcccattcagtatgatattggctgtgggtttgtcatagatagctcttattattttgaaatacgtcccatcaatacctaatttattgagagtttttagcatgaagggttgttgaattttgtcaaaggttttttctgcatctattgagataatcatgtggtttttgtctctggctctgtttatatgctggattacatttattgatttgcatatattgaaccagccttagaatgaaatgaagcaagaagggaagtttagagaaaaaagaataaaaagaaatgagcaaagcctccaagaaatatgggactatgtgaaaagaccaaatctacgtctgattggtgtacctgaaagtcatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagtggaaatgaaggaaaaaatgttaagggcagccagagagaaaggtcgggctaccctcaaagggaagcccatcagactaacagtggatctctcggcagaaaccctacaagccagaagagagtgggggccaatattcaacattcttaaagaaaagaattttcaatccataatttcatatccagccaaactaagcttcataagtgaaggagaaataaaatactttacagacaagcaaatgctgagagattttgtcaccaccaggtctgccctaaaagagctcctgaaggaagcactaaacgtggaaaggaacaactggtaccagccactgcaaaatcatgacaaattgtaaagaccattgaggctaggaaggaactgcatcaactaacgagcaaaataaccagctaacatcataatgacaggatcaaattcacacataacaatattaactttaaatgtaaatggactaaatgctccaattaaaagacacagactggcaaattggataaagagtcaagatctatcagtgtgctgtattcaggaaacccatctcacgtgcagagacacacagaggctcaaaataaaaggatggaggaaggtctaccaagcaaatggaaaacaaaaaagggcaggggttgcaatcctagtctctgataaaacagactttcaaccaacaaagatcaaaagagacaaagaaggccattacataatggtaaaggaatcaattcaacaggaagagctaactatcctagatatatatgcacccaacacaggagcacccagactcataaagcaagtcctgagtgacctacaaagagacttagattcccacacaataataatcagagacttgaacaccccactgtcaacattagacagatcaacgagacagaaagttaacaaggatacccaggaattgaactcagctctgcaccaagtagacctaatagacatctacagaactctccaccccaaatcaacagaatatacatttttttcagcaccacaccacacctattccaaaattgaccacatagttggaagtaaagctctcctcagcaaatgtaaaagaacacaaattataacaaactgtctctcagaccacagtacaatcaaactagaactcagtattaagaaactcactcaaaaccgctcaactacgtggaaaccgaaaaacctgctcctgagtgactactgggtacataacgaaatgaaggcagaaataaagatgttctttgaaaccaacgagaacaaagacacaacataccagaatctctgggaggcattcaaagcagtgtgtagagggaaatttatagcactaaatgcccacaagagaaagcaggaaagatccaaaattgacacctcaacatcacaattaaaagaactagaaaagcaagagcaaacacattcaaaagctagcagaaggcaagaaataactaaaatcagagcagaactgaaggaaagagagacacaaaaaacccttcaaaaaattaatgaatccaggagctggttttttgaaaggatcaacaaaattgatagaccgctagcaagactaataaagaagaaaagaaagaagaatcaaatagacgcaataaaaaatgataaaggggatatcaccactgatcccacagaaatacaaactaccatcagagaatactacaaacacctctacgcaaacaaactagaaaatctagaagaaatggataaattcctcgacacatacaccctcccaagactaaaccaggaagaagttgaatctctgaatagaccaataacaggagctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagctgggaagagacacaaccaaaaaagagaattttagaccaatatccttgatgaacattgatgtaaaaatccccaataaaatactggcaaaccgaatccagcagcacatcaaaaagcttatccaccatgatcaagtgggcttcatccctgggatgcaaggctggttcaatatacgcaaatcaataaatgtaatccagcatataaaccgaaccaaagacaaaaaccacatgattatctcaatagatgcagaaaaggcctttgacaaaattcaacaactcttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggtaattagggaggagaaggaaatacagggtattcaattaggaaaagaggaagtcaaattgtccctgtttgcagatgacatgattgtatatctagaaaaccccatcatctcagcccaaaatctccttaagctgataagcaacttcagcaaattctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggatgtgaaggatttcttcaaggagaactacaaaccactgctcaatgaaattaaagaggatacaaacaaatggaagaacattccatgctcatgggtaggaagaatcaatatcatgaaaatggccatactgcccaaggtaacttatagattcaatgccatccccatcaagctaccaatgcctttcttcacagaattggaaaaaactactttaaagttcatatggaatcaaaaaagagcccgcatagccaagtcaatcctaagccaaaagaacaaagctggagcatcacgctacctgacttcaaactatactacaaggctacagtaagcaaaacagcatggtactggtatcaaaacagagatatagatcaacggaacagaacagagccctcagaaataacgccacatatctacaactatctgatctttgacaaacctgagaaaaacaagcaatggggaacggattccctatttaataaatggtgctgggaaaacttgctagtcatatgtagaaagctgaaactggatcccttccttacaccttatacaaaaatcaattcaagatggattaaagacttaaacgttagacctaaaaccataaaaaccctagaagaaaacctaggcattaccattcaggacataggcatggacaaggacttcatgcctaaaacaccaaaagcaatggcaacaaaagacaaaattgacaaatgggatctaattaaactaaagagcttctgcacagcaaaagaaactaccatcagagtgaacaggcaacctacaaaatgggagaaaattttcacaacctactcatctgataaagggctaacatccagaatctacaatgaactcaaacaaatttacaagaaaaaaacaaacaaccccatcaaaaagcgggtgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactctaaactagttcaaccattgtggaagtcagtgtggcgattcctcagggatctagaactagaaataccatttgacccagccatcccattactgagtatatacccaaaggactataaatcatgctgctataaagacacatgcacacgtatgtttattgcggcactattcacaatagcaaagacttagaaccaagccaaatgtccaacaatgatagactggattaagaaaatgtggcacacatacaccatggaatactatgcagccataaaaaatgatgagttcgtgtcctttgtagggacatggatgaaattggaaatcatcattctcagtaaactatcgcaaggacaaaaaaccaaacactgcatgttctcactcataggtgggaattgaacaatgagaacacatggacacaggaagggtaacatcacactctagggactgttgtgggttggggggacgggggagttatagcattaggagatatacctaatgctaaatgacgagttaatgggtgcagcacaccagcatggcacatgtatacatatgttacaaacctgcacattgtgcacatgtaccctaaaacttaaagtataataataataaaattagattaaaaaaaaagaacattctttttcttttgaatggacttgacacccttctcaaaaatcagttgtccacagatatatgtgtttatttctggaatctcaactctagtctattgatttatatgtctatgcatatgccagtaccacactattctgattactgtagctttgtcacaagttttgaaatcagggaatgttaagttttctaattttttttcttcttgttcaagattgttttggggactaggggccacttacaattccatgggaattttaggattagcttttccatttcggcaaaaattcctgttgatattttgatagctattacatttaatctgtagattgctttggttattattgtcacctgaacaatatttaagtcttccaaaccatgcgcatgagatagctttccatttatttaggttttcttgtcttactttcaacaatgttttgttgtttccagtgtacaagtgtttcacgtccttgattaaatttatttgtaaatattgtattttttggatgctattttaaatggaactggtttactgatttccttttcagatttttatactagtgtacaggcataaaactttttgtgtgtttttttcttgaaccctgtaacttttctgaatttggtttacattttttgtagactctttaggaaaatctctatataagatcttttttttttttggatatgctttttttttttctttttagtatttattgatcattcttgggtgtttctcggagaggggatttggcagggtcataggacaatagtggagggaaggtcagcagataaacatgtgaacaagggtctctggttttcctaggcagagggccctgcagccttccacagtgtttgtgtccctgggtacttgagattagggattggtgatgactcttaacgagcatgctgccttcaagcatctgtttaacaaagcacatcttgcacctcccttaatccatttaaccctgagtggacacagcacatgtttcagagagcacggggttgggggtaaggttatagattaatagcatcccaagggagaagaatttttcttagtacaggacaaaatgggagtctcctatgtctacttttttctacacagacacagtaacaatctgatctctctttcttttccccacatttcccccttttctattcgacaaaaccgccatcgtcatcatggcccgttctcaatgagctgttgggtacacctcccagacggggtggcggccgggcagaggggctcctcacttcccagacggggtggccgggcagatgcgcccccacctcccggacagggcggcggccgggcggaggcgccccccacctccctggtggggttgctgctgggcaggggctgccccccacctcccgaatggggcggctggctgggcgggggttgccccccacctccctcccggatggggcggctggccgggctggctgccccccacctcccagatggggtggctggctgggcgggggctgccccccacctccctcccggacggagcggctggctgggcgggggctgccccccacttccccgacggggcggctggccaggtgggggctgccccccacctccctcccggatggggtggctggctgggcgggggctgcccccacctccctcctggacagggcggctggccaggcgggggctgcaccccacctcccggatggggcagctggccgggcgggggctgcctccctcctcctggacagggtggctgccgggcggagacgctcctcacttcccagacggggcagctgccaggtggaggggctcctcacttctcagacggggcgggcgggcagacatgctcctcacctcccagacagggtggtggtggggcagagacactcctcagttcccagacggggtcacggttgggcagaggcgctcctcacatcccagacggggtggcggttgggcagagacactcctcagatcccagacggggtcgcggccgggcagaggtgctcctcacatcccagatggggcggcggggcagaggcgctccccacatctcagacgatgggcggccgggcagagacgctcctcacttcctagacgggatggcggccgggaagaggcgctcctcacttcccagactgggcggccaggcaaaggggctcctcacatcccagatgatgggtggccaggcagagacgctcctcgcttcccaggcggggtggcagccgggaagaggctgcaatctcagcactttgggaggccaaggcaggcggctgggaggtggaggttgtagtgagccaagatcatgccactgcactccagcctgggcaagattgagcactgagtgagcgagactccatctgcaatcccggcacctcgggaggcccaggctggcagatcactcgtggtcaggagctggagaccagcccggccaacatggcaaaaccctgtctccaccaaaaaacacaaaaaccagtcaggtgtggtggcgtgcgcctgcaatccctcggcaggctgaggcaggagaatcaggcagggaggttgcagtgagccgagatggcggcagtacagtccagcctccgctcggcatcggagggagaccgtggagagggagagggagagggggagggggagggggagagggagctatataagatcttatcatctgtgaatacacagaattttacttcctgttgcaatttggatgacttacttttatatcttacctgattgctcttcctggaacttccagtactatgttgaatagaagtggcaaaagtgcgtattcttgtcttgttcccaatcttaaggggaaagcagtcagtctttcaccattgagtatgatcctagctgtgagtctgtcataaatgtcctttatactattgaggaagcttcctttatttcctagtttgctgtacgtttttatcataaaagcatgatagatttttaatgcattctctgaatccattggcatgaccttgtggtttttcttcttcattatataaatgtgcattacattgattgatttttgtatattgaaatgcccttgaatttctggaacacattcagtttagtcatggtatatactccctttaatattctgttggattcaatttactactaatttgttgacttttttcacccatattattaagggatattggtctatagttttcttttttgagatgtatctgcttttggtgtcaggataattcaggctgacctctagagtgagttaagaagtgttctgtcatcttctaattcttgaaagagttttaaaaggattggttttaattctgttttaaatatttggtagaattcatgagtgaagctatctttgcctggacttttccttattgggaggtttttaattactgattctatgtctgtacttgttacaggtcttttgagattttctagttctctgtgtcagtttaagtaatccatgtgcttctaggctcgctttcatttcagcttatggttatttgtgtgttttatttttcttaagttgtaagttgagctacaactctgttgtttttttaactttctatttcatttctctccactctaatctttgttatttccatccttctactagctttagatttagttttctcttcattttatagtttctcaatgtataaagctaggttgttcatttgagatctttcttttataatgtaggcatttacattacatatcagataaacttccctctgagcactgacttcattgcatcctatactatttatcatgttgttttttctcattttcatttcttcttcagtgttttctaatatgctttgtgatttcttaattcattgtttcagagtatgttgtttactttccaaatatttgtgatttgtacagctttccttcagttattgatttctaccttcactcaattgtggtcagagaagatattgtgtatgaaatcagtctttttaaattaattgagacctaccatacaccccctatgcctatgccataggtgttgtggcttaacagatgtcctatacttgagaatattccacatgtacttgagaataatgtgcattgtggtgcaactgggtggattgttttgtatatatctgttatatctagttggtttatgctgttattcatgttccatttcataattgaacataaggtttgaacccttcaactatggttttagaactattttttccttttaaattagtcaatttttgcttcattcatcatgggactctgttgttaaatgcacctatgtttatcactgacatatttcccaggtaaatttaccctttgatcactatgtaatgtccttccctgtctcttgtaacaattttttactcagttccaaaatgcctaatattagtatagctacccccagctctctttactgtttgcatgaaataactttttgcttcctttcactttcaacttatttgtgttttgcgatctatagtgagtcttctgttggaagcatatagttcatcatggcttttaaaaatcacttatggcaatctttgtcttttggttggagggtttaatccatttatacactttttagtatttttaatttcaaaataaaaattgtatacattcatggggtacaatgtgatatttctatgcagaaatatattgttgaatgatcaagtcaggctaattaaatatccataatttcacatacttattatttctttgtaatgagaacattaaaatccagtccttaaataatttttaagtatacaatacattattattaactacagttaccattcaatgaaatagatcaccagaacttaatcctcatgtctaactgaaattttgcaccctttgaccaacatttcccctttccccatacacccaacccaagtccaccattcttctctccacttctatgtgtttgactttttaagattccacataagtgagatcatgtcatatttatcttttgtgcttggcttatttcacttaacatactgtcttctaggttcatccatgttgtcacaatggaaaaaacttccttcttttttatggctgaatactgtttcatttgagatacatatatatatagttaaaaatgtattcacgtgttgataggtgatgaacttttcttttctcagctattatgagtaataatgtgatgaacatggcaatgtagtcatgtctttgacatactgacttcatttctttggatatatatccagaaggggactgctggatcatacgctaattgtatttttatttttgggtggatcctccatactgttttccaaaatggctatactaattcacattcccatcaacagcatacaattgttcccttttcttcacatccgcatcagcacttacctttcatctttttgatcataggtattctaacatgtatgaggtgacatctcactgcacttttgatctgcatttctctgatgattagtgatactgagtattatttgatatatctgttggtcatttgtatgtcttcttttgagaaatgtctactctggtcctttgcccattttttttcaattcagatatttgttttcttgttaatgagtagtttgagtttcatatatatttttaatataagctccttttctgatgtagtaatccatcttggccaatgccctaacttttcaaacaggctccccatgactttcctgtgaggcattaggcagtctattgtatgtctcaatcatagcattttgcccagggaagcttcaggttttagttatccacacaatgtttttcagcaatgactgctgctttctcacactgagtggactccacattaggtgaaacagagatgactgcctgtgtcactccttcaggcagctcccagatggttaggaaagacacatggaaaaatctgtgagtatggtctgttctgcttcctccagagtctagaatcagggtttcacactgggaacacaggttgccatctttaagatggctacagagccatggagggggcggggcaatgtgaagtaaaacaccacaaagctttcccaccatttcatatttgctttctttttgattcaccacattttgtttgtgttgctataaaacttcgactgtttgccagagttctgacaacttcgttctaacttctgcttatttctcagtgttactgtgaaggaacagcatctggagctgcccacttcaccattttgttgatgttttatcctcaacagcttgagaaaatcttctctagaattccacccttctatttttcactcactcttttgctaatacacaaaacttccttattccccatgtcatacccacttccttattcctcactgtcatacccactcagcaacacagaaccttaaatgaacccaaacatctacctctttcttaccttcattgggactttctcattcacatggataaaaatcacacagccaggcatactggttccattccacatttgtgatcaccaactgcaggtggattttccactatgctgaacaattatacaatatggatcatatgtcagcaaatcttttcaatgtatgcaagaactcttctgagcctgttcctttctcctcaaacatttgaccatgggttcctgtttgccccttcactcttaaaatattactttatttcctacctcaaggatcaataaaagccattctatgggaaatctctcaacatcctcttggatgtaggaattcaacttcactcgaaacatctccttatcactccctcctgctgcatagaataggttttcccactctgaccaaagcccagtccctacaactctgcagcagatcccatttttctctaccttatcaggaaatgtcttctattattcatctctttgctctcctctattttctatctctcctctatgcttgttcactctaattagcacttaaactcagtcctctcttgtcattaaaataaatgataaagatcaataagtgagatcatgccattaaaggaacatcaggtgcaggggccaagtggtagggcattgctctcatataatcacatctttctccttcactgtttaaaaaatgttgactagatttgttttgtgtactttaaaaatatttatagattctcaggcaagatggctgaataggaacagctccggtctgcaactcccagcgagaccaatgcagaaggcgggtgatttctgcatttccaactgaggtacatggttcatttcatttggactggttagacagtgggtgcagcccacggagggcgagcagaagcagggtggggtgttgcctcacccaggaagtgcaaggggttggggaactccctctcctagccaagggaagccctgagggaccctgccgtgaaggatggtgctatctggcttagatactatgcttttcccatggtcttcgcaacccacagaccaggagattccctcaggtgcctataccacaagggccctgggtttcaagcacaaaactggacagctgtttgagtagacaccaagctagctacagatttttttcgtaccccagtggcgcctggaatgccagtgagacagaactgttcactcccctggaaagggggctgaaaccagggagccaagtggttctgctcagtggatcccacccccacagagcccagcaaactaagatccactggcttgaaattctggctgccagcacagcagtctgaaatcaacctggggtgctcgagcttggtggggggaggggcatctaccattactgaggcttgtaggcggttttcccctcacagtgtaaacaaagccaccggaaagttcagaatggatggagcccaccacagcgccgcaaagccacagtagctagactgcctctctagattcctcctctctgggcagggcatctctgaaagaaaggcagcagccccagtcaggggcttatagataaaactcccatctccctgggacagagcacctgggggaaagggtggctgtgggcacagcttcagcagacttaaacgttcctgcctgccagctctgaagagagcagtggatctcccagcacagtgctcaaactttgctaaggaacagactgcctcctcaagtgggtccctgaccgccatgcctcctgacggggagacacctcccagcaggggttgacagacgcctcatacaggagagctccggctggcatctggtgggtgcccctctgggatgaagtttccagaggaaggagcaggcagtaatctttgctgttctgcagcctctgctggtgatatccaggtaaacagggtctggaatggacacccagcaaactccagcagacctgcagacaaggggcctgactgttagaaggaaaacagaaagcaatagcatcaacatggaaaaaaaggacaaccatgcaaaaactccatccgaaggtcaccaatggcaaagaccaaaggtagataaattcacgaagatgaggaaaatccagcacaaaaaggctgaaaatgccaaaaatcagaatgcctcttcccctccaaaggatcacaactcctcaccagcaagagaacaaaactggatggagaatgagtttgacgaattgacagaagtaggcttcagaaggtggataataacaaagtcttccaagctaaagaagcatgttctaacccaatgcaaggaagctaagaaccttaataaaatgtcagaggaattgctaactagaataaccagtttagagaaaaacatcaatgacctgatggagctgaaaaacacagcacgagaactttgtgaagcatacacaagtatccatagccaaatagaccaagcggaagaaaagatatcagagattgaagatcaacttaatgaaataaagtgtgaagacaagattagagaaaaaagaatgaaaaggaacgaacaaagcctccaagaaatatgggactatgtgaaaagaccaaacctacatttgattggtgtacctgaaagtgacggggagaatggaaccaagttggaaaacactcttcaggatattatccaggagaacttcttcaacctagcaagataggccaacattcaaattcagaaaatacagagaacaccacagagatactcttcgagaataacaaccccaagacatataatcatcagattcaccaaagttcaaatgaaggaaaaaatgttaagggcagccagagagaaaggtcaggttacccacaaagggaagcccatcagactaacagcggctctgtctgcagaaaccctacaaggcagaagagagtaggggccaatattcaacattcttaaagaaaagaattttcaacccagaatttcatatccagccaaactaagcttcataagtgaaagagaaataaaatcttttacagacaggcaaatgctgagggattttgtcaccaccaggcctgccttacaagagctcctgaaggaagcactaaatatggaaaggaaaaaccagtaccagtcactgcaaaaacaaaccaaaatgtaaagaccatcaacactatgaagaaactgcattaactaataggaaaaataaccagctagcatcataatgacaggatcaaattcacacataataatattaaccttaaatgtaaactggcttaatgccccaattaagaggcacagactggcaaattggaaaaagagtcaagacccatcagtgtgccgtattcagaagacccatctcacatgcgaaaacacacacaggctcaaaataaagggatggaggaagatttaccaagcaaatggttaaaaaaaaaaaggagtggttgcaatcctagtctctgataaaacagagtttaaactaacaaagatcaaaaaagtcaaagaagggcattacataatgataaagggatcaatgcaacaagaagagctaactatcctaaatatatatgcacctaatacaggagcacccagattcataaagcaagttcttagagacctacaaagagacttagactcccacacaataatagtgtgagactttaacatcccacagtgaatattagacagattaacgagacagaaaagtaacaaggatattcaggacctgaactcagcttcttgattttgccttaatgtcattacttacccaaaagtcattcaggagcaggttatttaatttccatgtaaatttatggttttaagtgaactccttagtcttgatttctaatttgattgccctgtagtccaagagattgtttgttacaattgcaattgtttttaatatgctgaggagttttttccttccaattatgtgattgattttagagtgccatgtggtgataagaagaacatactttctgttgtttctggttggagagttctgtagatgtctattatgtccatttgatccagtgctgagttcaggtcccaaatatccttgttaattttcagtcttgatgatctctctgatattgtcagtggggtgttaaagtctcctactattattttgtgggagtttaagtctctttgaatatctctaagaaccgtgaatctcctcctgtgttgagagcatacatatttaatgtgattaggtctcgttgtgttgaaccctttaccattagataatgccatactttctcttttttgatcgttggcttaaagtctgttttgtctgaaattaggattgaaaccattgtttttttttcctgttttccatttgcttgatagatttttctccatccttttattttgagcctgtgtcattgcatgtgagatgggtgtcttgaagacagtataccaatgtgttctttatccagtttgccattgtatgccttttcattggggcatttagcccatttacatcaaaggttagtattgatatgtgtggatttgatcctgtcatcatgatgttagctggttattttgcagacttctttatgtggttgctttatagtgtcactggtctgtgtacttcagtttgtttttgtagtggctgataatggtctttcctttccatatttagtgcttccttcaggagttcttgtaaggcaggtctggtggtaagaaattccctcagcattttcttgtctgaatatgatcttatttctccttcatgtatgaagcttagttaggctgtgtatgaaattctgggttggaatttcttttctttaagaatgttgaatataggtcccaatctcttctggcttgtagggtttctgctgagaggcctgctgttagtctgaggtgcttccctttgtaggtgacctgtagctttctctctagctgcctgtaacatttttactttcatttggaccttggaaaatctgatgattatgtgtcttggggatggtctccttttgaagtattttattgtggttctcggcattttctgaatttgagtgatggcctctctagctatgttggggaagttctcatggatgatatcatgaaatatgttttccaggttggttccattctccccatctttttcagggataccagtgagttgtactttggttctctttacataattccacatttcttggatgttttgttcactgtttcttttttctctattctgtctgactgacttatttcagaaagccagtcttaaagctctgagactttttcctctgtttagtctattgtgctactaatacttgtgattgcattgtgaaatccttgtagtgtatttttcagctccatcaggccagttacattcttttctatactgtttattttgtccgtcagctcctgtattttttatcatgatttttagcttccctgcattgggtttcaatgtactcctgtagctcagttatcttcataccagttaatattctgaattctctttctgccatttcagccaacttaccctggtttagaacccttgctggagtggtgatgagatcatttggaggaaaaacggctttttgagttatcagggttcttgtgctgattctttctcatctttgtgggcttatcatccttcaatctttcaggttgctgacctttggatgggtttttttttcttttatcctatttgatgaccttgcgagtttgattgtgacataaggtggattcagccaactggctttatttctggaagattttatggggccaatgctcagctcccaacttctggactgttgccctaactctgggggacttgtattgggccctaactttcctctctagatccttgaggttaggaatccactgtgctggggaggctgaggtgctcccaggctgctggtcactccactctgatgggtggtttcagccaaagcatttcataatgtggtgagagcaggatctgtcctcgtttgcacatgccagtagcagtggtaatggcagctgaagcagaatgtttgtggatgccagggtgcctgcttccctgcaagcattcaccacagtggtggaggcaatgcaggtgtgtggggatggggtcccttgctggcagccatgtacgtggttatgctggaggtggtgtttgttccgggatggggtgctggcaggcacaggtctagatgccttctttgtgccccacaagcaggagtgcatactaaggggtaggatctgctctacaatttccttcatcaatgttttgcagttttccttgtagaaatttttcacccttttggttaaacgtattcttaggtattttattttttgtagctattgcaaatgggattagcttattgatttggttttcagcttgattgttattggtgtatagaaatgctacttattttgtatgttgattttgtatcctgaagcttgaacaaatttatttatcaagtccaggagtcttttggaggaatccttagggttttctggtcagaagatcatatgatcagcaaacagaaatattttgcagttctcttttccaatttgaataccttttatttctttctcttgcctgattgtgctggctaggactttcagtgccatgttgaataggaggggtgaaagtgggaactcttttattcttccagttcttaggcagaatgctttcaacttttccctattcaatgtgacaagttgaatttggctgtgattcaggctggtcctggactattttttgcctgggagattctttatgactgatcaatctcactggatgttattcatttttaaaggatttctacttcttcctagatctatcttgagagattgcatgtttccaggaatttacctatttcctgtgggttctagtttttaagcatagcgatgtcgcttcatgatcttttgtatttctgcaataggagggttgcatatgtgggttttcacatatggctttcattattttgaggtatatttctcctatgcctaatttgttgagggtatatatgatgaagggatgttaaattatatcaagtcttttgtatgcatctattgagatgattaattttatttaagtcacgaatcacaattattgatttgcatatgttgaatcgcccttcatctatagaataaaattcatttttttgcattatatttttgatgtgctgctggattctgtttggtagtcttttgttgaggatttttgcatctatcttcatgaaggatattggtctgtagtgttgttgttgttgttgttgttacatcctggtctgacttttggatcagggtgatactggaattgtagaatgagttagggaggattcctcctcctgtttttggcacagtttcagtaggattggtatctgttattcttcatgtgacaagttaaatttggctgtgattcaggctgatcctggactatttttaacttcggagattctttatgactgatcaatctcactggatgttattcattttttaaggatttctacttcttcctagatctatcttgggagattgcatgtttccaggaatttacgtatttcctgtgggttctagtttttaagcatagtgatgtcgcttcatgatcttttgtatttctgcaataggagttgttatgattcattttacatttctggttgtgcttatttgaatcttctctcttctattcttggttagtctatcaatcttgtttacctttacaaagaaacaatttttcattttgttgacccttggtattttttttcattctcattttcatttagatctgctctgatctttcttatttattttcttctgctagctatgggtttggttttcttgataagcattgttcttgataagtgacatcagattgttgagttgcaactttttaatatttttagtgtaggcattcaacactataaacttccctctcagtactacttttgatttatcacaagaggtattcatatactgtctctctaatttcattcatttccaaaaaaattcaaatgtttgtctttactttgtctttgacccaaagatcattcaggagtttgtttaattttgatgtattttatagtttcaagagttcatcatggtattgagtgctagttttattccactgtcatccaagaagatatttgatatgatttttaattttttaaatttattgagacttgttttgttatgtaacatatggtctatattggcaaatgttccatgtactgctgaaaagaacgtacattctgtggatacgtgtagagtgttctgtaaatgtctgttaggtccatttggtctaaagtcccatataagtccagtgtttcttgattttctgtttcaatgatctgtctgctgtcagtagggtattgaagtccccccaattattgtattgttgtctatctctttttgtaggtcaggagcatttgttttatgaatctgagtgctccagtgttgagtacatatatatttaggactgttacatcttcttcttgaattgattgctttaccattacctaatgaactttatttcctaaagtctgtcgatctctaggctgcaaggtagccaagagccatgaacaacacctgccccacagctctccactaaaatggctgtggtgaagtacttactccatcaaaccaaaacacacagcccaacagctctcctgctctcccctgcaggagtgctgccactccatgtaaggcatggagggcaccttacatgcaacacagtggccgcactgccagtggggacacatttgcccctagcagccccagaaaggctgtcagcattcttgggccagtttcccatggaagcagccatggttctcagtgggggtaggggaggagaagtgtccttctccatgccttggcttgagcactgaggccacttggccactgggatggaactatattcctgccttgcagagtgcagcacagcccttggatctctgctgggaatggtgccatcactcagagctcacaagcagggagctcctgggcactataaagtgcatgatctggtttcctttgtcctaggaagagttccctcactgtgctgctgcactctcccttcccttaggagaaacagtcccctagggctagactactgaaaatcctgcatttatccaccctgtgcaactgctgcaatccaaatgagcactgaggaatgtctgagagggttcctgtaatgtggacacaaaagggctgaggttccctgggcaggaaacactcccccgaggactgtgcctggagtatagcacctgtagtcacagctcgggtcctggggagggagagtgaccaggaacaagttagcattttgatataatgccctcaagaagtctgcaaattatcacccatgccagtgtttggatctgtgtgaacagaggagctctctgacagtgtggatgtttaagcccagtcttactgtctatttcttgaaagatccaactagtacaaggaccggattggaaaatacatgcaaagataggatctggaactggttcatctacttctctgcaggcaaagagaatggcatcctgaatcatgggtcaggcacataacataagatggtgtgaatcaaagcacaaatggttctaaagatttcaacagtgatgactcaggcacacattcgtgttgaggggaatactgtggtaggtacaatgatgctgatatctggaataaatatgcctaccaagaaggtggaattggctgataattgctcagtcatattgatgcttgcataagaaaaatgaaagactgagagtcagtaaccgtcagttaacagtaaatgtgagaaccagagagcctcattgtaggatataaagaggtctttatcacctgtactggaagagaagacactgttaataggcagtctgaagatgtaattttgagattatagagctccagaaatgttcgaatgctaatccaaggcagatttgggatcctgaaaactgtgaagaggtcatttagatggacaccctggaggctgttggctctgtaaatgccctggaccctctgagcatgcagaagtggctcatcctttcctagtaaggactagaaattccactttgtggaatatgctatagaattttcacccccacagggcagcaggtgaccacccatgagcttcccttacctcttctcctgaatgccaggatgaaaaataatgtgaatgggaacattctaggcctaataaggaaagagactataggccttacaaattacaaggattagctgacatgtactggcagaaagcagacaagtgcccctggaagtgtgtttggagagggattgattaagcaaattagaatataaggctgaatatgcaagaattctttgacttggggtgcctcctcagggtacaggattaaacactccaataagaaccacagagaatgatgaaaatccacagatggatggttctaggaagcctggaaaaatggccaaatctcagtgaaatataaatgcccaagtttccatggaaagaagatataagaaagaataaagaagctgaaggaagtgagaatgctggaatggatagattacttaaagctagaagacacatgagagaattttgtttctctgaggtgcccagaggacactcaattctccaaagccatcaggaatgcactggtgggaggagtatttaaatcactaggaagtttgggggcagctctttcctgtaggccagggatgatggtaggagaaatggtcacatatcagtaagcacagctcattatcaatggtgttgttggacacctggagtaacagagctatgtagtggtactttgctactatagacccagagaccacaattactataatgatgaacaaagtcagaagggaagtcagtagggctccatcgctccatctgcagggaattgtagagatggttaatagataatcgtattcctaggagcaaaataaacaggtatcccacaagggtgatgtttagcatgcataacagaaaaaaagcaaaaatggaaaagcagagcactgagtacagtcattctaagcaacagttatgattccttgctcagttgccagttctgagccaactttcagatctgaaacccactgactgatgaggtgattagctttgtattatagaaggaagggccctgcaaaccatggcaagtatatgctataattattcttctattccttctacaagggatctatggccatataggcctttggggtggaatgaccaaatattttaaggaattttatacacaggatcaaagttgacactgatacccaaagactcaaaatgtgaatataacctacctcttaaagtaggaattcgtgggacatagggaataaatggaatcctgcctaaagtccagctaaaaatgtatcctgtgtgaatccagatttacccaatattcatttcctgtccatccctgagttcatagcttgaatccaaataattggcacctggaatcaaccccacagtgggttcctgatttgtggaataagagctgtcataatgaagaaggttaaatggaaacctctgaaacaaccccaacccctgatgatgcccaagatagtaaatcaaaataaattacgatgtcctgcagtggagactaatgacagatactgctgccattaaaggcttaaaatatgcatggtggtgatatggtttggctctgtgtgcccaccgaaatatcatgtcaaattttaattcccagtgttgtaggagggaactggtgggaggtgattgaatcatgggggtcaagttcccccttgatgttctcatgatagagttctcatgagatctggttgttggaaagtgtgtagcacttcccccttcatgctctcttcttcctgctccagccatgtaggacgtgcctccttcctcttcaccttcaccataattgtaagttttttgagacctccctagccatgcttcctgtacatcctggagaactgtgaatcaattaaactccttttcatcataaattaccgagtcttaggtagttctttatagcagtgcaagaatggactgatacaaaacatttttaattaactcacggttccataggctgtacaggaaacctggctggagaggcctcaggaaacttacaatcacggcaaaaggtgaacaggaaggagacatgtcctgcatggcaggagcaggaggaagagagagctacgggggaagtgctacacactttcaaacaaccagatctcatgagaactctatcacaagaacagcaagggggaagtctgccccatgattcaatcacctcccatcaggcccttcctccaacaatgggaattacaattaaacacgagatttgggtggtgacacagagccaaaccatatcaggtggtcctctttatcgtgtctccatttaattctccagtctgtaccctgtataaagtgggtgggtcctagagaatgctatagacaacaacagactgacccaagtgatagctctggttacagctgttgtaccaatcatggtgtaattgctaaggtacatggcatggtacatggtgtaaagtcccaggtatatggcatacagccactgatttggcaaacatattctccatttcattgaacaaagaataccaaagctagttcacattcacactagatggaaaacaatatcctgctatagttttacagcctggcaatgttattctccagccatctatgctaatatactctgggaatatctgaaatacttggccagcccacagaacatcacaacaatacgctacattaacatcatcatgctgattgaacaagatgagcaagagttgactgttggatgccttggtaaaacacatgtgatctggagaatgggaggtaaatcacatgaagattccaagaccaaccacttcagtaaagtttgtaatgggtccagtggtcaggggccatattagtcaaagttttaccaagagacaggatgcataggatgcaagtatataaatatataaggaaatttattaggagggttatctcatgttattatggaggccgagaagtccatagacaggccatctgcaggctggagaccctgaaatggataatatgcctcattccagatgccaaggtctcagaaccagggaaaccgatgatgtaattcttagtctcagtccgagaccaaaggtctgagaacctgggggtccatgggtgtcaatcctagcgtttaaaggccccagaacctggagttgtccaaggacaggagaggaagaatgtatcccagttccagcagatagaatcacacatttgtcttttctctgttcttgttctctgggccccagctatttggatggtgcctgctcacattgagggcagatctctgcgtagtccactcagacacaaatgctaatcttctctggaaatgccctctcagacacaccccaaaataatccttcatgaagtttctaggtatttcttaatccagtcaaattgacacctaaaattaacaatcactggggcatgtcaggatgtcacttccaaagtatgagaaaaattgtcatgtcttggttcccccaccaccaaaggaggaagcacagcaacttgtaggccacagtaggttctgaaggcaacatattggacaactagaaatataccagccctcacatctatagatgaggaataatgcttagttttggtagaacctggagtaggaaaaagtactgtagcaggtccacacaatggtgcaattagccctgcctcttcagccataagtgccaacataacaaagagtttgtagtagtcagtggtgtgaaaattggcagtataatgcttatggcaagctctaatgtaagcccctgggtttctggggtagggccatgccatccacagcagagagttcagcagatagttatttaccctttaataaacagctcttgatatgtttctggacccagatagagacagaacatatacgagataccaagtgaccatgcatttgcattatgagctgaggtttctcagacaaacaaaatcataaagttagatgagtcaggcagcagttcatcagaagttggaaactgaatatcaaggatagagcccaagcagagatatatgccatgagtaagttacatagccggtggcccagacctctatgacacccaccaaagttgcataatttccactgttccagttgacacctgtagctgtgtggagaatcctgaatgatcaactgaaaatggatagaaaatgccaagcttggtttacagatatcctaacccaacatacaggtggttaccagaaatggaaattggctccattagagtcacattcaggagtggccaaaaaagggaaaatcttaccaatgtgcagagctttgagtaaggcatttggccagccacccaatgtagaaggagaaataacctgaagtaaaaatctatacagatttatggggagtggccaatatcttagctgtctagtttggggcctagaaagaaaatgattggaaaatcagagacaaggaggtctgaggtagaggcatgtgtttagacatgttggaatggacacaaagtgtgatgatttttgtaatacacattaacattcatcacaaagtctacaccatggaagaggaactgaaaagcaagtaaataaaaccattcaaccagttgacattagtcagcccatgttgtaggctattgcaaaactagcaatgggcacatgaatgaagtcgccacactggcagagatggaggcttcatacggatccaatggtatggacttccattaccaaggccaatctattgtctactgcctctgggtgttcaacttgtaagcaactggaaccaactctgagtatccaatattacactattccttgtcatggccagtccagtttaccttcacagggatcagtccctatcccaggtatggatttccttccttgcctacagcacttcactcagcagaactacttgggaacttatggaatacctgaatacacgagcatgggatttctcatggcatagcacctgattaaggggcccattatatggaaaaataggtacagaagtgaccatgggattcactggacatatcacatgttacaaaatccagagacagacattctcagagaatactagaataatctcaatgcacaactgaagcacaactcagaggaaacactctgggaaaatgggttgccatctttcaggaaccagtgtatttattaaatcagaaaacttataaagcaacttttcctcagtgaggacacacgggtccaggaacctagtggtagaggcaagagtggtcccacttaccatcactcctgatcacccattatggattttgtactcacaactctgttctgcactgttggaggtcttggctccaaagagactttctggtttcacttttcttggggcaactcagaaaatgcccccattgaactacaagttataactcccctacaccttctgttgtcattttggactggtactcagaagctagcaggtgcacagaggagtcaccatactggcagggtaatggctcctgatcaggaggagaggataaggttaccacaacacaatgagggcagggagaaatatgtgtgaagcctgagtgattcattttggtgcctcctaacactttcttcccattgtaactgtgaatgaacatgtacaatcatcctgaactgagaagcatataattatcaagggttcaccttcctcaggaataaaaattttgatcataccgtcaggtaagccagcaaggtctttcaaaatgatagctgttgatgcagggaatttaaatgaatagtgaaggaggaagaggatgaataccagttatggccctgagatctactgcagtaacatctcttctgattttcccctcaggaagaaaggcccacagaaacaattatggagctgtcccccaaatctcagtaaagaagttgatctgtgttgtataagtagtggacagtggtggccaggagtatgtgtgtcacagaactcctacagggagcgcaaatgacctttaatcctatcttggcatccacttttcagaatgcacagaccaacataacatatcattgaaaaatttgctttgtttcactgaacaatgtgtcctggagaataatttaagacaatttgtagaaatatcacattctttaaacaaccacatattattcttcaatggatagacacctagaacattttgaaatttccactttttacaaacaaggctgcagtgaatattcttatacatgcctctttgtgcatgtttcattgagatataatgtacatacttgtgggatacatgtgacaatttgatacatgcaatgtgtaataatcatatcagggtaattgaaatatcaatcacctcaaatatttatcatttctttctgttaggaacattccaaatcttctcttctagtgattttgaaatatacagtacattattgctaactgtagtcaccctactgggctattaaacactagaaattattctttttttgtagctgtatttttgtgcccaaacacagcctgtcttcatccctttttcccctacccttccaaacctctggtagtcatcattctactttctgccttcatgagatcaatttttagctcccacatttgagtgagaacacatgatatttgtgtttctgtgcacggcttatttcacttaacatactctctgacttccagactcatccatgttgccacaaatgacaggatttcatttgttatatggctgaatattattccattgtgtccatatgctacatttcctttacccattcatccactgatgggcacttaggttgattgcccatcttgactattgtgaacagtgatgcaataaacagagaagtgtagctatctctttaacataacaatttccctgtggacatattcccagaagtgggattgcttgatcatgtgttctttttattttgttgaggaacctccatattgttttccataaaggctgaacgaatttacactcctaccaacagtgtatgaaaattccctttcctccacatcctcaacaacatttgttatttctatctctttgttaacagtcattttaactgggttgagatgatatttcattgtgggtttgatgtgtagttccctgacaattagtaatgtggagcatttttaaatgtacctcatggccatttctcttttttttttttttgagaaatatctattaacatcattttccccttttaaaatcagattattcggccctttactgttgagttatttgagtgcctcatatattgttactaatccctgttggatggcctgtttgtaaatattttctcccactctttagattttttcctcactccattgtttatttcctttgccacgcagaagcttttagcttgatataatcccatgtgtctatttctgctttggttgcctgtcctttcgtggtcttatgaaaaaaaaattttgcccaggccagtgtcctgaagcatttcctcaatgatttattctagtaattagtctcaggtcttagatgtaatcctttcatccatattgatttgatttgtgaatatggtgagagacagaaatctagtttcattattctgcatatggatgtccagtttttccagcagcccttattgaagagactgtcctttcctcaatgtctgttggcacctttgtcaaaaataagttggctgcaaatgtgtggattcacttctgggttctctataatgttccattggtctatgtttctgtttttatgccaggaccatgctgtttagttaccacagttttgtggcaggtagtgtgatgcctccggttttctttttttgctgagaattgtttttgctactcgcggtttttcgtggttacatcctcattttaggactggtttttttttctacttctgtgaagaatgtcatttgtattttcataaggattgcattgcatatccatccatattgcttgggttgtatgtccaaagtttaacaatgctttctttcagttcatgaacatgggatatctttctattttttgtgtcctcttcaatttatttcatcagtgttttgtagttttcattgtagagctctttcctctctttggttaaagttattcctatgtattgttttgttgctattataaatgggtatgctttcttgacttctttatcagatagtatgttgttgatatattaaaatgctattggttttttaattttgattttgtatcctgcaactttactgaatttatcagtccatcagttttttggttaggtgtttagtcttttctaaatacattatgttatgtgcaaacaaggacaatttgacttcttccttttcaatgtagatttccttcatttctttctctggcctaattgttcttgaaaggaaggacttccagtagtatgttgaataaaagtggtgaatgtggatatctttgtctcgtcccagatcttagaggaatggctttcagtttttccccattcagtttgatgttagctgtgggtttgttacatacggtcttcattgttttggggtatgttccttctacacccagtttgttgagaggttttaccatgaaggaccattgaatttcattgaacacatttttttagcatcaatcaaaatgatcatatggtttttgtctttcattctgttgtgatgatatatcagtaaatgttaactgataacatttactgatttgtgtatgttgaaacatctttgtgttgctgggctacaccccactttatcatgatgaatcatctttttaatacattgttgaattcagtttgctagtactttgttgaggatttttgtatctacatttatcagagatattggcacatagttttgtttttctattgtgtcttcttctggttttgttttcagggtaatattggccttgtacaatgaatttggtagtatttgattctccttgattttttggaatagattgtggaggattgttattagttctttcttaaatgtctggtagaattcaaaggtgaagccatcaggtcatgggcttttctttgatgggagatgttttattacagcttctgtatcattacttgttattagtctattcagattttcaatttcctcctggttcaatcttgggattgaattgttttgtttgtttctaggaatttatccattttttctaggttttccaaattgttggcatatagttgttcataatactctcaaatgacttgaatttccgtggcatcagcagtaatgtctccttttcatcgctgattttatttgggtaatctctgttttttttcttagtctgtctggctaaaggtttctcagttttgcttgtcttttcaaaaaaaaaccaactgtttgtttcattgatcttttgtatcatatttttggtgtcatatattttctttggctctgatcttcattatttttctactaatttgtggtttggctttgttgttcttttttctttcttcctttctgtcttcaaaaggggagaaatcattttctctggtagtatgttttaattttttgccttctattttttgtgtatctgttgtgggattttaatttgtggttaccatgagatttgcaaataacatcttataatccattattttaaactgatgactaattctctctgattacaaaaaagaacaaaacagataaaactaaaaaaccctacactgtaactccatctcccaggcccaccttttaactgtttgttgtctctatttatatttatttatactacctatctcttaaaaagttgacatggtaattatttttgctaggtttgccttttaatctttctactcaaaatataagtagtatatacattgcaattacagtgttagatttttctgtatttgtctttgtacttactattagcagcatgttttacaccttcagatgatttcttgttcattaatgtccttttcttgcaggcttaagaactctcttcagcatttcttgtagtacaggcctggtgatgacacaatctctcagcttttgtttgtctgaaaaagtcatttctctttcatatttgaaggatttttttgctggatataatatcctagggtgaaaggattttttcttcagcactttgaatatgtcatcctgctccctcccggcctgtaatgttttagctcagaattctgctgccagacatattggagctcctttataggttatttgtttcttttctcttactgcttttaggatctttctttgacttttgagagtttgattattaaataccttgagcgagtcttattttggttggatctgcttggtatgctatgattttatcatacctggatatttatgtcttgctctaggtttgaaaagttctctgttactatttctttgagtaaactttttaccctgattttcctctttatctcctctttaatgccaatgactcttagattggctattttgtgactattctagatcttgtagacatgttttattattttgtatattttcctcctccgagtgtgtttttcatataacctctcttctcattcaccctttcctttgcttgatcaattctgttgttgagagattctaacgcatatttcagtttgtcagttgaatttttcagctctgtcatttctgcttgattgtcttaattatttcaatctctttgttaattttcttttatagaattctgaaatcattctctgtgtggtctttacattttattgaactttctgaaaacagctattttgaattctctgcttgaatgttcacatatctccatcactctgggatggatcaccgaaggcttatttaattagtctggtgaggtcatattttcctgaatgttcttgatgcttttggatatttgttgatgtctgggcattatgtagttaggtattcattccaatctcagcagtctgggcttatttgcacccatttctcttgagaaggcattccaggtattcaaagagaattgaatgtggtaatctaagcctgtagtcattgcagtcatattaccactagggggctccccaaacccggtaaccctgtgactcttgcagactcctagcagcaccctcttggtgggcctgggtaagatcagagagaattccctgggctatcaaacaaaatctctccctctcttccctctctttctctcatcaagagtctctctccatgctgggctccctggagtagggggaagagtgatgaaagcactcctgtggccaccgctgctggcactgcactgagtcacacctgaagccagtaaagtgctgggtctcactcaaggcctgtggcaactactacccggctaccactgatgtttattcaagtctcaagggctctttagtcagcagtttgtgaatcctaccaggactgggtctgtcccaacagggcagcagattcccttctggtccagagtaggtctagaaatgctattaatatatgatctatggcctggaatcaggggcttcagaaatcttttaaatttcttcaggaatattacagtggctgaactggcactggacctgcaagacaacgtcctcgggactcttccctctgctttcccaaagcagaaggaaactcttctcaagctgcactgcctggagtttggggagggcagacaggtactcccatggccaccacaactggtgtctcactgggtgatgcgcaacccaagtccactgcctctgagcctagtgcagcaacagggcttgcccaaggactgcatccttgtggcctgactgcctctcaaatttattctgagacccaggccgctttagtcagcgagttggggagccagccagaatttgagttccttccactggggctaagaattagcctctggctgtggctggtctagttgctttttctgtgggcaccagcagaattctgccgttttgtgttccactgtgacagagcagaactgaattccaaagcaaagttccacaatcacttcactctttttcttccaagtatagattatctctctgcacgatgctgcaggggcttggaggatgggtggtgtatccaatgcaaaactatgtttcttaccttcttaaaaccacattccttgatattagattggtgcaaaagtaattgtggtttttaccattaaaagcaatggcgaaaaccgtgataatttttgcaccaaccaatattatgttaaaccaggtgctgtaatcactaacctgattttttttggttcttatgatggtgttgtcttgcatgaacagtcatgtaattggtgttcctgtggcaggggacaatcactatagggttctatttggccatcttattctcgtccttctctctttcttagtctagctagaggtttgtcaattttgtttatcttttcaaaagactagctttttgttttattgatcttctgggggtttttttcgtctcaattttatttatgttttgctctgatctttatattattcttttccttctagtaatttggagtttggttggttcttgctttcctagttctttgaagtccattattcatttgttaatttgaagtctttctacttttttgatgtaagcatttattgctataaactttcctattagtgttgcttctgatgcttatcatagcttttgatatattatgtttccaattttatttgtttcaagaaatttttttaattttcttttaatttcttcattgaccttttgtttgttccagagcatgtaatttaatttccatgtatttgtacatttttcaaattcctcctgtttttgatttccattttcatagtgttttggtcagaaaaggtgcttgataggattttaatgttgttgcacttactgaaacttgttttttggactataatacagtctttctttgagaatgtttcatgtgctgatgagaagaatgtgaattctgtaacagttggatgaaatgttctgtaaaagacagttagatacatttggtctagagtgcagtttaactctgatgtttccttgtcaattttctgtctggatgatctgtccaacactgaaagtcgggtgttgaagtccccaactactattggatttcaatctctctcttcctttatatctattaatatttactttatatatttgagtgctctggcattgaatgcatatatatttataattgttacatcttcttgctgaactgaccacttcatccttatataacaaacttctttgtcactttttactgttttttacttgatgtgtattttatctgagagcagcatagttactactgctctttttgggtttctattttaatgtaatatcttttttctgtctctacacttccagtctatgtatgtctttataggtgaagtaacattaagcatataattaggtgctggtttttatctattcagtcactctatgtcttttaattggagaattcagtccatttacattcaatgtaattattgataagtaaggacctcctactgccattttattacttgttttctggttgttttttttttaactcctctcatcctttcttcttttttaatgtcttcctttatggttaggtgtttttcactggtggcatgttttaattcctttcttttcattttaagtgtttctattatagaatttctgcttgtggttaccatgaggcttacaaaaaaaaactctatagcaagctattttgaactgatgataacttttatcataaggaaaagaagcaaacaaacaaagcaacaactaaacaattttacactttaactccatccacccacaattacgctgttgcctcaattatcatctttttatatcatatacttcttaataaagtatagtagtcaacatcagttttgataaatttgagtttttagtctttacactaaaagtaaggtccatttacatgccacaattacagcattagagtattctgaatttgcctgtgtacttacttttatcattgagttttatagcctcagatgattttttcttgcacattagcatctttttctggctaattgaaaactccctttagtatttcttgtaacacaggtctggtggtgatgaattccctcaattcttgtttttcctgaacagtctttatcttttcttcatgttcgaaggatagcttttctgggcacaatattttttttttccctttggtacgtggaatatgtcatccctctccctcttggcctaaagggtttctgatgagaagtccattgtcagagaaatcagaactccttcatatgttatttgcttcttttgctgcttttaggatcctctctttgtccttgacctttgagatttttcttatcatatgccttggtataggcttcctttggttgaacctgtttggtgatacttgaccttcctgtacctggatatttatatgtttctctatgtttgaaaagttttctattattgtctctttgaataaactttctaccccttgctctttctcaactcccccttaaaggcctatgactctcagattttcttttttgaggctattctgaactcatatgcattcttcacttttgacatttttttctttcctataaatgtgtattttccacatatcctgttttcatgctcactaatttgctcttcagcttgatcacttctgctgttgagaccctccatgtgtttttcattttggctattgtatttctgttccagaatttgggtcttttaattatttaaatatctttgttaaaattctctgatagattcatttatcgcttttctgtgctttgagtttactgagtttccccaaaactgctacattgaattcatgagccgagagctcacacagcattatctcattagggtcattagctggctccttgtcttgaccatttgaggaggtcatggttccctgtttgctcatgtttctgatggacatatgcctatgtctttgcattgaaggaatagttgtttattcctgtcttcactgtctggcttggtttgcttttgctagggtatgtctgtctagaggttttgtgtcaattgactattgagtttccttagcttgagattgctgcctcctttttggcactagatgtctccctaagcctggggttgctaaggctgttggaaaatttggagcactgcctgtcctggacgggacttcacgaagaacataccctggctttgtgagaaggctggctacaagtctgtggcccaaaggatctctgtagagtgccacctactgtgtggtgctgctaaacagcctctctgatttgatgtctcttttggctgcaataaagaagaggcactaagtttcatgtgcagggtggtgctagccacatcttcatcctttctctagctatcctcaggagttttcaccctacaggcacttgtgattcttctcatggagtgaggcaggaatggttttcttgtgaaggaacccaagtttgtgggcaagctgaatatccacctcaatgtcacttttccagtgtagaaaccatgagttctagagatttttttgcacagtgcttcggggaggactattgcagttagagagctccatttttttttaaccttctgctcatgatttttcacttatcttgggcccaggagtcatcacgaccttgattttgagttttaagatattactggtgttagtcttgtacatttacttataattacaattaatgtttttgcacatactctgtgcgtatctctagacattttactattgctttcattgacttcacgagtttgcataaaatccttacatattccatatgtttatctttgcctcttttctacatttcaaatattttcttccaatttttctcattatctttacttgtaagacatttaaaatcttatgctgtcaaatttatcaatcttttttataattacttttatcttcaagaaatccttctctacctttaggtaataaaattagtgtcgtatttattttctaaaatgtttatagctttgatttctcatttaggtatttatctatctttttttttttgtaagtgaatgctctcagaaataatagttatagcctcctccataactctttccccaagtagataacctattttcccaacaccatttaaaaaaaaatattccaccttttccccactggcttacaatggcttgtttcttgaatacaaattcccatatttgatgtgtctgcttccagagtctctcttcatttccattcatccagtcatgaattagtataccattatcattccttttaaaaattcactagataccttattgtcaaactacccacattgtttaacatttcttcaaattaccatgtcgtcttgtctatattttatgacagataaatttttaaatcatcttgttaggcttctttttttaaatctattttcttaaactgttgggatattatttgggatggccttgaatttacggattcatttgcaatacccatctatcacatcaaggaacatggtgtatctctcacttaatgtaccttttttttttttttttgatacagagtcttggtctgtcgcccaggctggagtgcagtgacatgatctcggctcactgcaacctctgcctcccaggtccaagcgattctcctgcatcagcctcccgagtagtagttgggattataggcgtgcaccaccacaaccatctaatttttgtatttttagtagagacagggttttgccatgttggccaggctggtcttgaactcctggcctcaagagatccactcgcctcagtctcccaaagtgctgggattacagatgtgaaccaccacacccagcccgtaccttttctttatagccttcagtgatgttttatgttttttcctgtagttcttgcatgtatatgcccatatgaagataatttatggatttgggactattggcagtgtatgggacaacacttgatatttgtggaatgatacagacttttctgtatcattccacagaattgttcaattagttaaacataacttattagttctgaaattttaatcgttgattctttcagattacttaaataggaaaaaaaatccaaacttttatttctagtctcattaactgacaagatctttgttgtactagtgaatgttagtggcaactgtagttataatggtttcaaaatttaagtatagtgattcctatagctttttcatacatatagtatttatatagttaagagcactcctattttagtttttaccagttataaaggttcaatgtgtcaatacttgctgcacaactagtaaggatgttatgtctgctatttgtattttctcacctcctattgggtatagggtctcagttgatgtggacacctggagatctgcagtgtcatggcagctgcactgttggagagggttaaagagtgtaaaaactgccttaggtctagaaattgtacaagaatttgtgctttttttatttgagcaacttccctcagaccccttggtcatttatacttaatttttttttttttagctggtacaagcaaagtagtatccttatcatctgtctctctacttttgcataggggcaccatgttctattaatcatctccatgactctcaacacctccaacctccttggctgtctttgttaacttgcgtatcattatgacaacgtgaacccttggcttctggtggttaagagctgccacatcactattgtttcagagtcttatgttcccaaatcctgcaacaagccaagatcttcagcagcatctcctatactcagttcctacatatagtacaaaagaggagagtcactgttgaacttcttagagattctagtatctcctttagcagtgcattctttatggcttcagtaaatggtgtgtcctctggtctttggcatggaatgaatgtactcgtctggaggggcttctgttcacacatagtttatcaactgcagcatgtacatatccctgactcatttaatcccttccagcacaatataccacaacaattcttgcatttcaatctcacttagcatgggctattacattttcaatgctcctatgagtcatcttgcactggtctccctcctgcttactatgctgtaatcacacttagaagcattgctatttgttttgactccaatagtcccagctccttcctcactcaaagccttccaaagagttattctctcagtctgagggacacctcccaacttctcccactgttccttgcctggctaattcatgttcacccttccaatttcaacttaatcaccactgactcgaacaagctccccccaccgcaacccccgatctgatctcccctacagtaggtcaagaccttgtgatattctcccatagctttctgtacttcattgtgtatgtgaatcccaattttacttgctgagactaacttaatgcctgctttgccagctaaattgaaagcttcatgagggtagagatcccgtctacttgtttacttctgtgtcttcaagctttctcttcctaaaatatattttcctgcattcttgactaaaagtctctgtagtttttttagacttctaatcctggttcttacgctcatgtgattcgctctgggctttcttccattctgtgctatagttgcctaaagaaaacagtaattattattaacaacacaataaaaattatcaccaacagtgatgtaacatccaaactaaaaattccattccctccgcagaaaaatgaccaacaagatagttgcttgtttcatctttgtatcatccacagagcttggaaaagaacattgaaaaaattgattcttaaataaatatatgttgcgtgattgagtcctgaatctgaggatggggtaaaaaatgtcattctttctaaataaaaatattaataaaaaaaaaaaaagatagttgcaaaactcccaatggtccagtgtcaccttgctctgagtctattccaatgaatactcaatcaaatcttctgtatgtcagcctcttttccaatttaagcaaaaacaggaaacaccagaaattacccagagccattctgttaatattcctcaaaaagtagtgttgtaacttatgtgcacacaaccaaatggagaaaacatcatttgcccaactgcccaattttacattctgtgatgcccatacccacaaagtgcatgaaattttactatgataataatatcaaacaacaaaaataacacattaacaagagcaagtaagtaaatctcttacaagggaataaatcttgttagaattatttccatataatactatattttcaccattttttcttatttaaactttccattggttttaaacatgttaaccccaaaatacaaacactcagttgttctgtgaaaagtcacacctaattgcagtttcattctcacttaaattgagcagcttccttactgtggcattttggtagctctgcccagctgcttagtttttctctctcctggaggatcctctcttggaaactgagaaattcccaggagaaatgagatcccaggtgcttgtaaataccaggagataaggtacctctgctggtctgcagccatcctgaatccagcactgttccatcttccaccctcccactctttcacctaagatggcacaattagtggtgagtgacgaatcattccaactctcatcctgaaatgttacaggggtcaggagaacttttgctctttgtgggtaataatagaaaggattacttaataaagcatggaacctaaaacagtatgtcaagtcccatcatatgcttattatctcacaaactgaaagtggtcatttctgcaaaatacacactcagaaacacacacttaaaataatatgtccaatatttagccacttacctctatcttaatgaagacccagtttctaagagcattttgtattaaaacagtcatgatgtttctttatcatgccaacagacatacgacaatcatgaaaaaccatggacgtacttctgtggttttgaattatttaaagtcccatgaaggagcagtcaaagaaatggatgacgaagccgtatttcacagcaatttatcactatatattcacactcaaatattcatctctccccagtatggacacagctacacatttaaaatctcttgtaatttactcaacaggggctcacccatccagtcaacacaatatttttgtttttgtttttgttttgaaagccaagcacaaaattgcagtctgtgcacagatgcctgtgtagaaacacgatggggaggcctgcatctgaggaaggctctcctgacagaggacattgcaaagagtttataaggaagccctaggattgtgggggtgagtgtccaagctcactatgctgagaaggaagaagaggtgctgagtgggccagagcctaggctcacagccccctgctcaattacagctcctctgccatcctagtcttcatggactggggattatgcagaccaaaatgattgctaccctttcttaaagaaattattcaggtggataaaagaattatgccaataaaatatctggaaacaacagcttactagttttatgtaagagtactggactcaaaggaccatggaccaagttcacccatgggctgtctcgtgcagatggcgtgagagcatttaaggtacttaaagagtgatggcagaaagcagtggagtagtttagggaatggaagtggatactttcggccttgggcaaaaggggccaggtgggggtccaggaagggggacttgtcttcagacaaccaatgatagagcagacataataggatatgtaggacatgaaacttccgtgtgtatggtggggataaggttgagggaaaacaggggataacaagtgctgtttgggtacagatagggggcagcacggggacactgggtggcccacagctgtagaagggtgaatattaaaagagtagaagtatgactctctaattagctttctgatttggtatttgggcaatcttactaccttaactgtagcaacttgaatactaatgtggctagagcattagacaataagttgtctctgagcatatcagggtggccaagttactggggctatgatggtcttgtgtcaattccagggttcatattgaagatggagaatccagtggcattctgaatttaaccttaaattctgacatcatgaaatagacagtaaacatataaacacactaatcattaatcattagtgatatggaaagacattatcatcaattcatcataagaaaagatactaatcattgattcattaatcattatggaactgtgaaataaaactacaatgtgaaaccattacacaaacaccagaatggctaaaatgacatcaaagagaaacaccttgcattatagaaaatgtagagcagccaggactttctcacaaagctagtcaaagtagaagttggtacaaccacgtgagaaaacctttcccctgtagctattaaaaactgagcaagtgcatatcctatgactcagtagttcaactcctagttatatacccaacagcaatgagggtgtatgttcaggaaaggacatgtaaaggggtattcatagcagcattattcataatggtcataaactggcaataacccaattgtccaacaacagtggagtggataaataaaccacctcacaatgacactgaacaacatgtgctgctctccttgtcaaacaagttgcctaagacttttctatgttttgtcaactttccatgattaaatttgtattgctttaaaacaatgctgaaagaaaaactaaaggaaaaaagccatataaaccccatattaatcatttctactgaaacgaagtgtctgtggctccaggcaaggccgtttgaacatttgatctttccaagccacactgttcagtcaatccgattgtcttatgtcaaagcacctgaccttcagagctcccctcacagggttcaggtaatccccttgtgcctcttccatcttccacagatgtttcaagttcgttcactagacaagatgtgggctagaagtctctaattagacattcctctttctgaacacatcttcctctcccaccagcctgcctagagaactgctcttacaacatcacctgttcttcatccacacaggaacttccatctgtcctgttgtccttcacatgagcgaatggcacaagcaggttgggctctgagtgttcagaatgacttgctgtaaggattctggtagtctgagattgccttgaggttaaccttgggctgcctggggcactcctgtgttctctgttcctcccactaggtcaggcttacagctgacctctaagacgttaatccctcacaacacacacactgcttaatgctattcactgtcttgtgatgtcttgggccatctgtggaagtgaggaagctctgtccttctgagggagtggtaggagagctacctcagcatccctgagtgggttcaggaaactagctgatcctaagcttgtaaaaatgccaggtgataccaacatgacaggaatgcagtcctcaaggcacttgctgactttatccctcctgctcatcccttcttcacccttctgcccatatcccactgcccaagttgttttgcaaatcctgcttttgggagtaggcaatgtgtggcatgggtcaagacccactctatgacgactatgaactgagagaaggcagaaacaaactttccttgctgatgtcagctgttctctgaaaatggatgaagggtgtgaatatgaacaaattccagggaggagagagtgaggacaactgtcccctggaaggttgttatcctccagtatctggaaatcttcctttacctgggaactgaacagggctatcttttttttttttttgagacagggtctctctctgttccccaggctggggtgcagtggcgtgatcatggctcactgcagcctcaacctcccaggctcaagcaatcctcccacctctcagcctcccaagtacctgggactacaggcgtgcagcaccacacctggctaatttttgtactttttgtggagaagacattctgctatgtctcccaggctatgaacagggcttagagtgtggcatcagaggtggatatatacactggaagtcccttgccctgaaacatggaaaacatgcaaaccaggagtcataccataacctgaattgctccttgcactgaaggcagtcctccattctttgccccacatccccaacatgaccactacttttgcacagcatatcgagtggctgttgaactggttttattccttccagttgcctgcagcagtttctaaaattgctttcattttcaaagaaatacaaatacaactatcttttgacccaacagttccattactgaggatatacccaaaggaaaatgaatcattctaccaaaaaacaaaaaaacaaaaaagcacacatgcacccgtatgttcattgcagtgctattcacaacagcaaagacatgaaatcaacctaaatgcccaccaattgtggactggattaagaaaatatgctacatatacaccatagaataagacacagccataaaaaagaatgagatcgtgtcctttgcaggaacatggatgcagctggaggccattcccctgaacaaaccagtgcaggaacaggaaaccaattatcacatgttttcacttacaagtgggagcttaacattgggtgcacatgaacattaatggaaacagtagacactggggactataagaatggggagggtgggagaggggcaagggtgaaaaaactaccctttgggaactatcctcactacctgggtgacaagttcaatcatatccaaaaccttagcagcacacaatatagctgtgtaacaaacctccatgggtacccccgaatataaaataagttgaaagaaaaacaacaaaaaatgcttttattgctaaatgtgttcaccctgcctcaaatttcatttcattttgctctgattttcatataactctctttcttcactctcttttttttttttttgagactcgctcagcctggagtgcagtggctcgatctcggctcactgcaacctccgcctcctggcttcacgccattcttctgcctcagcctcccgagtagctgggactacaggcacccaccaccatgcctggctaagtttttgtatttttagtagagatggggtttcaccgtgttagccaggatggtctcgatctcctgacctcatgatctgcccgccttggcctcccaaagtgctgggattacaggtgtgagccaccgtgcccagccctctttcttcacctttcttaagtggtttatcgctgacggactctacaaaattgttctttaccccagaattctgacatctataaatgtttgagtgaagtactcaagaagctgttaggctgggttaccacatttccataggtatggccagtaaggaggccttgagtccaaatggatttggacactttattatgcattacatggcaggccacatgagcttcatgtttacatcagttactgtggttccccaagtcctacctagtggtctgtgacacagctgaggaattctgagcttaggaatttcccagtcttataagggcacagctaacatacctgatccaatgttgccatggaagaagccattatcattattattctagttagaaaacaaatctgccctctgaccgagagagagacattagctataatctccttgcaatgtctctgggttgggcaggagactcaagcattattacactggaatgtaagcaaatatgcttcctgacctggaacaactttgcaaatatcctcaaacagagctgtaaatgtcatttgttgagaagatgtgcagaaacaccaggcccatgcctttgggtggagaagggaatgccacctggatcaattaaaaaaaggtcattttgaaaattcaacattcaatcttaatgaaatttctcattaataattatcaggcaagcaacctagatgcctgatatcaccacttcagtcaagactttactgcacattctatcaaattatctaagacaaaaacaaaaagaatagatatgaataatgaatagaagagcaaaattttatcaccattttcagaaaatttcatcatccaccaagaggagtaaaatgtaggagaatcaatggaaaaatatcaaaagtaaaatagaagagtttattgagtgggaattacatcaaataaatatacaaaagtttacagttttctacatgcagcctatcacaaattagaatatagtaaaaaaaaagagtgcattctaaacagtaattataaataataatatatctagaaataaacttaggaaaaatggttccattgttaaacaaaagaaaatgaaaaactttaatgaaggtcatgaaaattctgaacacatgaatatgtcatattctaataaaacctgcatgagatatgagaaaatgtttaggattataattgaacttaaaggtgaactggataaatacacagcaatgtaacagctgtaaaaccaagattggattgaagaaaagcagataatgaacagggaattggcttaagtgatagcaaagttaatgcaacagttaagcagtatggttctggattaggaactgataaattgattaatggaaaaggatagcaggtccagaaatcaaaccctgtatacatgaaaatgtcacacacacacacacacacacacacacatgctataggggaagggaaaggaaaagagacagaacaagtctgactgcattctgaagaagcagcagaactcattcctgcagaaaactttcttaccttcagaacaaatgaggctctatagagctccgtcaccaccagccctgctgtcagccctggaagatcccaggaaggggaggccaactgactctggcagtgcatcctcactcctcctcaggagactgggaggtaagggtgttggttttcggaacagaagcctcagatcagcaatggatcccaggccctgattgcagccaaggggttgaccacagcatgaggacccatgttgtactaaagccagatagagtgggccctggagtctggctggcccctgctgtcatcccctggagaccccaggcaggatgagattcctcaacttccccatcagaggtctcctggaggtgagagccatggtctgaggggtcaggactcagattagtagaaaagagaaagtctattccattccaggaatcacggtgaggaccccgagtgagtattcaggggatcagtcgctctggagcagagaggatgccagagtcccacccctgctgtcggctctggaaggcctgggaagggctaacaagatgaaatgtttccttgcttccctgcaggtgtctcaggatggtgaggccttgggtaagtggtggtggaggactcagttcagcagaagggaggccacccattccctgccaggtaccaaggcacagaccctggatgaagatgaaaggcacaacccaccccagaacagagggggtcccacaaaatctgacttctgtggtcagccatgcaaggcccccagtagggctatctcactgaggcctccactggctttctcctaaagaggctctctgtgtggctcagactggatctaaggggttgacctcaagtgagcagaaagaggagacccaggtcctcctagaagtctagctgaggagtctgagggaggatggaggagaccaagcaaaccagaaggtgcagagaccctcacctgtgctatctgctctcagaggcccagggtagaggttactggaagacaggcatgatcacttcctcctcggtgttttctctgcggtggggcctgacagcaaaggcatcaggtcaacagaggaaggaatctcagatcctaccaggagtcaaggtggagacctgcaaagttcagcagcccccaagaccaccctcacatctgacaccaactgcaaattcgggtgtccccaagccccacctcaggtttgataatgtgctagaaggactcacagaactcacagaaagctggcatactcatggttatggattattacagtgaaaggatacagattaaaatcagccaggagaagaggcacacagggcagagcccagggagttccaggcacagagcttccagcgttcctctctgtgttgagtcccagacagcactaacttctaggtatgacagtacacatggagtattgctaactccagaagctcacctgagcctttgtgcccattgtttttattgagactgagtcgggttgacgtggttgaccacccacacaactaacttcgagcattagcacctctggaggccaagcgaataccatgtgacccaaggctgccatcataagtcattttcagcacagcctatccagtgcggcccaaggtttccagataaacatggacacgatgatcaggcaagacatcccaagggcttagagactgcctcccaggagccacggccagacctctctctgggcaaggatttttctctaggcatttccttggacaatgtaatcttttaccacaaggtacaatagaagaactaagggggcctcccatgcctgaccaaagggatctctgcacaactccagccctgccctcagtctcagagaccctggcagggctgtttagctaagaaccctgtcgcttcttcttctagactctcaaagagttgagggcttgatttgaaggggttgatcctaggtcagcagattggatggagctaaggccctccctttaagttgaggtaagaacccttattgagaattgaggagaccaccacctcagattagaagagaaccagcacagtctggcccctgctgttcactctgggagtcccccaccctcactctcttctcagagataataggaagtgagagccttagtctgaggggacagtcctcaggttggcagatggcagggagtgcaggccctgcctggagtcaaagtgaagaccctgagcgagaatggagggcaccactcaccccatcacatggtggactccacagagtcccatccctgctgtaatccctgagccttagcagctcctgggaatggcttcattgagcctgaggcatccctccacctccttcttggggtctcgggtctcagggtataggccaacaatgtatgcagggcatttctcactgtgagcactttcagcacccaggaatagagctcaggtgtttcatggatcctgccaagtacagtctcagtgtccaggagcatgagggatttaggtagccatgactcatgagactgaggtgcaccccggaaggataaatccaccccagtcctcctggatattcccacccctccacaggaagtagggagagatggttttaaattctctcctaattctactgctggtatttgggagtttgtggttggaggataaacttgagctttctctgttgagggtggagagtgtgggggtttgacggggacagcctcagattgagcaagacaggcccttccaactgccaaggcgatgacccctgaatacaggctgaatgtgccaccatctgatgctcctctctcaaggctgggaagcccagagaatgactgcttgctactgaggagctagttcactctatcctctagggtctcagggaatagagtgaacagaaggaccaaagcatgggtcagtattctaaagcacaaatggcagagacagccttccttcaatccatgggagagattgcttgctgaggcccctcacgtgtccctcactccatcctcctccttcctccctgctcctcctctggggccccatgtcctgccctcctgcccacattcttatcaaggcccctgagcagagtcgagcttggggctcagaagagttgaagcagagcccacaagaaacactgccaggcctgaggtgagaaccaggctcttgaggctgaggaggaggccttctccccactctcctgttatcagatcacaggctgctaaggggaaacctgctggtgggacactcaatgctcctccatgtccttggaatccccgtttcacctccactgccaccttacctccctcagggaacagctcaggtgagggagcaagcagccacgaggaaaagcaagggccccacccctttctgagttcaggcccagggacctcttgagcagtaatgtggctgagttggaggtgttcctgctgctcgagaaccagaagaaggaacccacacaaaaggcagaaatgctgaagcatatcatccaacagcaaatggatcacttccctgaggtcctcagcaaagcctctgagagcctagagtactctttggccttgagttgaatgaggcgaacacagatgccaggaagcaatgtgacatcctcatcaacaaagtagaactttcctctgctgagggactgagtgagtaaagactggggcttgctccaaactgttattctagacctagttttcatggagggcaactttgctcctgaagaggacatctggaatatgctgagagagttgaagatgctgaggggaagcacatcatttctgaaagtcccagaaagcttttcgttgaagatgttttgcagcaacaatatctgaatttgaggcagatgcccaacagggatcctatatgctacaaatttctgtggggccctcatgaccacactgaacccaaaaccgtgtacattttggggtttgtggacaaaattattcacgttgacttctggtcctacagttcagtgtgcaaagaggtcctgagagaaaatcaggacaaagtccaagccaggatttcagggaataggggtactaatgccatggagtgtgcaggggtcagggccattgccagttgtacaactggtgccagtgctatggccagcaggaaacataagtcaggctgaggcaggtaattcactctgtttttaaagtaggcactcaaatatgctgtagtgagaagtagtgaatagctgcatgtgtgaggggaacacaaatggtgttccattgctgttcgctatggactgaattgtgtatccccagcatttatatgttgaagccctaacccccaatgtgacttggaggtagagcccggaagaaggtaattaaggttaaatgaggttgtaagggtggagccttaattcaataggattattgcccttctaaaagggtagtaaaatgtccggctgacaaaaggccgagtggcaatgccttctggagtggggatcatgtattctagaggaaagagttttagggaccctgaatagggttgggcgaggaaggtctacagatatctaaatataggaatacatggaattcctttcgtgtgacataaaatgtctgctatacataagattctacacttctatctttaacagaattgtgaggtatgcaaaaggactgggtatattagatttaaataagcaaagcaaaggtatgtgtcctgctttcataagctaataacaactctgaaaacctctaaagcaatgagtgtaatgagcactatgtggggagtgtaagctttcatctggatataggcctggtctggagtctcaggggaagcagtttcctgtagccgtgggcttcttctcatcctggtgttggagctccaggcatcttgcatttggtatcaggtattggggctgaattccagacgtctgcatgtgccttttgtaggtgggatatgtggatccagcagtcaatgacctgtaacttagcaacacatagttgagtcaggagtaccaggaatggacctttgctgcggggcttgaggaagttttttagctggcgtcttttctagtaaatgaagtctcctagctagagttcatgatatcagagttcatcttttgatggacgaccatagaaggattccacaaccagtttatggcgagttgttagagcctgaatgagtccttggcagtaggtcaggaggtctccttgtaactgagtagggtaaaacattccctcagttaaatgcatgggatggcctgcgacaatctcaaaatgggagaggtggtgttttccagagggggtagacagcaggatcagtagagctagacggaaagccctaggccacgacagattaagagtgtttgtaatctcaggcaatgggctctttattattccattgattcattctacaagcccagaagactgtgggcagtaggtggatggaagtgttacagaataggccagacatcacaaactcattctaatgcttggctagtaaactatgttcctcaatcactgtggagttcagtaggaacttcccaagtggggataattctttcaaaaagaattttggctaatacggccatgatttgtttgtaagcaaaggcctctacccaatgggaatacatacctatcatctcaagtacatacttgcacccaagtgaggaggggtacttagataaaatcaagttgccagcttgcaaaagggccatttggcaaggggaattctttgggggcagcctttgggagcttcccagcattatacaaagaacagattttgcaacatttatagatttgagaagcaaccactgggagaagaccccaattgtactgttttccccactggattattttgtaaaggctccaatgggtgaggttatgtttaaaggtatgagtggccctttgtaaattttctggaaggacaggatgaatgttaagcctcttccataactgagattatgatttgtaggtataaccctgttttgcccattttttctttttttcttttttttttttttgccatctgtggacatcttttgagaccttgagagtctggagaaaagttttttggaaggtacaaaaaacttctgagaagaagcctcaggcagagtatatcaaggttgtgtcatcaaggagaaattagggatccaagctctatggcagaccacaagtccccagaaacccctaagttaccttttagtattgggcaagggaaaagaatatatgccttgaaagcaggtgaagtcagtgtttactcttgatgcccaaggagcttgatggagtcccagcaaaaatgtcatttgtcttagagccttgtgtgccttaagggctagctggtgaagtaagaggcgagtgtcagtgtggcaagccttttgagagagggagcataaaagcaagtcatcaatgtattgtaatggagtcaaattatctgggaaggttatttcttttaggtcagcctgcagaatctgggaaaggtgggaagggcttttggtgtatccttgggaaagcaccatccatgtaaattgttagcctttccaagcaaaggcaaaaagaaactgacttttggggccgacaggaggactgaagaaggtgccgcagagatcaatagtggagaaacagtgagtgtcaggaagaatcgtgggtaagagtggttgtggattaagtacaacagggtatcagggacagacaatgttgtggatagctctaagatcctggatgcatctccgtcccttcatattaggcttacagactggcagaacggatgtgttacaaggagtggtgtagaggactatgagtccgtggaaaatgaaaccgctgactatagattctatatcagcctaagtttcagaattgaggggacattgttttaaatttggaagaggactgttagtgtctatctgtatagaaataagtgatgctgaatggaacaggccaacaactgcatccactttcacctaaagagtttcaggcagttgttttagaattgggtgttcagtgacaactgcatagctagaaactagcagggaggagatatgagtgacactggaggctgaaaccttggctggggagacttctaagacgatatctcccctctgggtgaaagaaatgtgggcttggtgtctttgagaacgtctctcactatcaggtggattggggcagagaggacaacagcaaactgtgttggccggcaaggggccctaattgataagaaactgactcagacttaaaggcggtcatagtttggttagtgaccctcactatttcaattgtttgattactctgaggggggtttgaaaaggagttgagggtaagcaccaagagcagagctccagtgttgactagagcttggatcaatttgctgttgattttaagaccaccttctcctacttagttaggaaaggaaaaaatccccctcatttcccccagagagtcctcagttttatccaacaaaaacttcttacaatttctcacgagtaggaggggttccttgccttacttgggtatttctgaagccattgtttgtatttttcccaatctcattttatatattcaggacccttacaggaaaagcaaatcatgccctttaaagtagacaaggctactgctttctgtctattttgtggggcttgctgatttgaggctttgagttgttgaatatgtaaggccacaagtttagtagtcttttcctcatttctgctttagcctctttttctttttgcatggtttttgagaggcattcagccagggaagctatttcctggggtctcttgaagcttagtagggattatattgtttagctaaagtactaagggcttcattgagacctgaaaggataagtgaattttaaaaatttactgtatcatcagttagatctttgacaccacagttctgttggcaagtttttaaaaatcagtcaaaatagtcacaaacaggttttctttctgaacgcatcacagaatagccttctggttactttttttctggaaggagcattggaatggatttaatcaatttagcgggaatttttcccactgtcttgaaggccctttcaccagtaagatgaaaatcttcttggggcctatctcagttacataatccaatcttcagacccacttcactcactgcctggactgagacaaatgtctctttctattcagatccagttttctttttctgaaactgttcttcagatcatcccttcatttcacaaccttggcagatctaaagagcagaggtgactccaagctggagcttcccaccatcttctcctgagcagatgcagacccatcattcaccacaggaacaccccgggctgatgctgtgcttctcctcagtgtagcccaccaggagcagcacagacccacccacccacctctggtgatttcaacctgatagtggttaaatactcctttacaaacacaaattttgtcatgtcactctcctgacttaactttgccaatggtttcccactggccttagaacaaggaccacagtgctgaccatagccccctgacaccgagtgctcctgcctgctgccctctcccttccagtccaccccagttgcctgccatctagtctgctctcttggggacacagcagactctagggtatctgggggattgcatacatattcttttaacccattcacccaaagcccactcttaccacattttctaagactttgtgcagctaaatccttaaaggatcatgaaatttcatattatgaaaatttcataatgtcattattcaaaagacaaaaaaaaagttacttggcaaatcatctgtgagaataaccctcaatttataaagcaagaaaatagtagctgaataccgagtccatatttgggataattagtagagaaatgctgagtgaaagccaaattgaaagaaaattgatcattaaaatttcataagaattgaatggagagtatattaccttgttgtattcttacccgtgtgtgtgtatatatgtgagtgtgtgtgtgtatgtttacgtgtatatatatatagacccgttgcaagatattttaggtttagacactgatgtgtacatgatcagtcaatacagttaactgataaaatgtcacagtccacatcctgacaatctatataaatatttaaaacaactttgtttatacaattaacaattagtacaggaaacagataattgttcagatgacttattaatatttatggatattgaaatgcagtaaaaaggtgtgattattatatcaaagctttgttatgggacttagggcaagtacacatccaacactaaaattgcaatgcatctcaatgaaccaaatggctgcctctgtcgccccctgatggatggcaaattcttgtccccatggaccttcactgaaaaacattagttcagcaggaaagttcccataattcagaatatcataaggaaggaaaaaaattttgccccaaaatatatttcttttttttttgagacagagtcttgctctgtcacccaggctggagtgcagtggcgcgatctcagctcactgcaacctcctcctcccaggttcaagcaattctcctgcctcagcctcctgagtagctgggactacaggcacatgccaccacacttggctaattttttgtatttttagtagagatggggtttcactgtgttagccagtatggtcttgatctcctgacctcatgattcacctgcctcggcctcccaaagtgctgggattacaggtatgagccaccgcgcccagcccccaaaatatatttctttgatataattggagattatataaagacagccagcaagaagaagtagccctgcaaagctgtcttttgtgggggaaacttgcatgtgtagaaaatttgcatgaactcagccaagccttcccttgtctggacctaggagaaaggaactaagattctgatgccttaatgactggaaagcaacatttaccatctatttactctgagggctgctacctacctgtgagagttcttctacctaacaagaccacccttgctagccagcctcctcttccctccctcccataacctgtcttgccactataacctgttttaccactatcacctgcttgtggccattccctaagccaacgtttttgctgtaatctcaggatggtatataagcttcctcaggtcattgggtggttgggtcatcatgctgtgatgttccctgtgtacacatcagtaaagtttctatgcctttgctgcaattaatctgtcatttgtgagttgattttttagcgaaccttccgagggcgaaggggacactttcccttggttcctacagtttgaggctgtgagcaggctctgctctcctgacccacagccaagtgaatccaggtcctgatgagccatcaaaagggtaaggatttcttaccagtcaggctccaggtctctgtctttctgtggaatctggtcaagtggatggtaaatattgttatttgtttttcttctccaaagtcttgattaatgggaggaaaggatttgtttaactcatcttgttctagtgactctggtatactttttggtactttgtggtttgaatattcatagtgtttggtcccttttctaccagaaatagtcttttcctttgtctttgggtgtccttctgtcatgaagaggagtatcattttaggttctctctcatcttgtttgatgtccttgaaagcttgacttgtgaccaagtggaaggactctcttggtctgtgccatccaggcagcataattttcgagtcccattgggtggccagtctcaaaaaggctgcaaaaccaagacattttgcttcgaatatgtcaagctgtcagctctcaggagagtttgtcttaaaaagttccattcctacacgacttttgtcatcctaacccttgttgcctagttagtgctgggaaagcccaatcccaggcaggcctatgcagtgtcacagattaaaaggtctgtgagtggcaccctcccccacaaattttgggttgccaaaggcaaacaccatcctcgacaatctgtggtaacaagagtcctctgctatctccttgatctctttggctattaagtacacacatgtgtacatgtgaatatatgttgtctacatatatgtatgtggtcatacatatatttgcatattacctacacgtggtaccacattaactcgaatgagtactcataaaattaaacctattccagggagaattttttggggagggggtctttgggtttgcttctctccagggaacatctttttttaaacctggaatattacatgctgggctttccatgaagaagctattggattgagtcactattggaatgagtacagcattggaaattcaatgaccagaaggtgaatcttttaaattagattcctgaaattttttcttgacccagcaatcccattactgggtatatacccaaaggattataaatcattctaccttaaagacccatgcacatgtatgtttattgcaacactatttacaatagcaaaggcttggaaccaacccaaatgcccgtcaatgatagactggataaagaaaatgtggcacatatacaccatggaatactatgcagccataaaaaaggatgagttcatgccctttgcagggacatggatgaagctggaaaccatcattctcagcaaactaacacaggaacagaaaaccaaacactgcatgttctcactcataagtgggagttgaacaataagaacacatggacacagggaggggaacatcacaaaacagggccagtcagggggtggggggcaaggggagggatagcattacgagaaatacctttgaagatgacgggttgatgggttcagcaaaccaccatggcacatgtatacctatgtaacggacctgcacgttctgcacacgtatcctagaacttaaagtataataaaataaataaataaataaataaataaaaagtcttttgagatctctcattctaaacaattgatgggaagatcaaattcaaagaaagacatgcaatagtgtcatggccagccctagaaattatcttgacacaattaagagcaaaaacctaacctaaacaaatttaaaatctttgtgagctcaaactgcctgctttggattccctgcaggattaataatgaacgctgctcaaccttgttgcacagtagttccaattccacactttcacagccttcgcttgggtttgatttctcctcaggaaaccagtccctgttcgttttatatttgtgtgacttttaattttgcgggtacccacttacatgtttggagatgccttgtgaatccttggttaagtcacagctttggttaaggcttattgctttcacttgggaaggtatctctagaaaaaaaagtaaaaacagaaatgtcagctgtttatcccagctaaaatcttttaacaagagattttaaaagttttttttaagagctctatagtcaaaagctgacttaattcaaactgatatttaggttatgtatgtacacatatatatatatatatattgtttaaggcttctattcgctctgtaaaaccttctcagtcaactgaattcctgtctttttaaacctctgctaaccatatttgctccctctgtctgcttctccttctattccgtgtgtccctccttccccttgcaactttcaatgccacaggaggggacctaaaaacaattctaactgcctgggatcctttaattaaaacagaaaaggcaacatgagtttctctttaggggaggaagctttgattttcctcatggaaccccaagagttttaagtggacagattcaagtctgaagctctacgactctcttttgcactaaactccttgatctctttggctattaggtacatacatgtgtacatgtgaatgttatatgttgtgtctacatatatgtatatggtcatatgtatatttgcatattatttacacgtggtaccacattaacctgaatgagtactcagaaattaattaaataagaccaaatattttttcaaatttatgtgacttgaataaatcttttggtaaataaaactatgttgttattgttggtttaataaaaataactgtcttctgagctaacaaaaaaatatacatgtgcttaatggcaaggttcttgcttttacgatacttgcctaatgtacagtaatataaaaaacagttaataaaaaatttaacttgtgatgatgactaggtttttctaatgtctcctaaaattgcctaaacataattgttaaaattaaatgaataaaacagatgtaaatgagataaaggtttataaatgaactttccacaagaatgttttatgatatgtttacttaggtttctcaatgctttttggtaatcacatacttagagttttcccaaactaaattaaatgatgggttagggttcagatgccatggagactgtggaacaaactgtctcaccttcatcagagactagtccagcaagaaagttctcatagttcataatatcatattgaaggaaataaaaatgttttaccacaaacattggccagatctaggcaagattaactgagagtctgactcttcccttcacccctgattaactgagagtctgactcttcccttcacccctgcaatatcaggccagatattttcttttctcatccgagaaaacctccaaagtagcattgttaaaatggctgttcctcaggtaggagtggaactacagaaaacaggaatatcggtacaacatgaaactttgtgaatatcataaaagataaaatatggaacacttggtaaataaaactttatgtattaaatatgctaattaatatctaaatatatgtaaatatcaattgaaatgctgaccacacattggaacttgaaatcaagagggcctaataatatactatgaaaatgatgagaactaatatggtttggctatttgcccccaccaaatctcatgttgaaatgtgatccccaaagttggaggtggcccctggcaggagggtttgggtcatgggggcggatccctcctgaatgggttggtgccctctgcgtggtaatgagttcacaagagatctagttgttaaaaagagtctgagatcatcccctactctcttgctgtctttctcctcatgtgacacgctggctccccttgccttccacaatgagtaaaagcttccgtaggcctcaccagacagagatgctggcgccatgctttttgtgtaatctgcaaaaccatgagctaaatgaacctttttccttgataaattacccagccccaggtattcttttacagcaacacaaaatggacaaacacaaaaactcagcaatattttagtttggaacccagctaactcctgcagtcaccctatgatcctgggtcacagacttgggtcatggtctctcttagcattacattctttgtctttaacaccagcatagaagaaaactttcccaggttgtccaggattcagtgagatgaattatgcaaacctgtcagttatatgggcatacactccaaagaactaaaagcagggatgggtatatatgggtatagactcaaaagaactaaaagcacccatatgcacagcagcagtattcacaatagccaaaaattggaggcaacatgagtgtccaccaatggacaagtagataaacaaaatgtggtatataatattattctgccttaaaaacaaaaggaattctgatacatactgcaacatggatgaaacgtgagtcattatgcaaagagaaataacctaggcacagaaggacgaatgctgtactcttccacttatctgagctacctagagtaatcaattcactggaacctcaagtagagaggtagtttccagggactggaggagagaggaataggaagtagtgtttagtgaatacagagttcctgttggggatgatgaaaaaagttctggagatggatggtggtgatggttacacaaccactgtaaatgtggttaatgccatagaactgtataattaagatggtttaaatggtaaatattaagtgtattcaatcagaaggaacacaggaatgaagtactgatgtatgttataacatggatgaaccttgaaaacatctaaagtaaaaggaacaagacactaaaggcacatactgtataaccccatttatatggaatgtccagaagggcaaatccatagagttcaggaagtagattagtagcttccagggactgaagagggggaaatgggaagggacatcctaatgggtactgagttccctttggaggtgataaaaaagctctggaactagataggtggctgtacaacactgtcaaggtgttaaatttcaccaaattgtatacttaaaaatagaagccatcattctcagcaaactaacacaggaacagaaaatcaaacagtacatgttttcactcataagtggaagctgaacaatgagaacacgtggacacagggagggaaacaacacacaccggagcctgccaggggtggggggcaaggggagggagagcattaggacaaatacctaatgtatgtggggcttaaaacctagaagatgggttgataggtgcagcaaaccaccatggcacatgtatacctatgtaacaaacctgcacgttctgcacatatatcccagaacttaaagtagaaaaaaattggtaaaagtggtaaaattcatatcaagtgaatttgcctccaaaatactcatctgttatatttatttcactgtgcataggatttgttcctcaaaggacacggtgccaagttgtagccttcctgagccctggctaccacactaactcttggggcccaagcccaaggtcttgagagatgcctttcatagctggacaacaaagcacaaaacagtgccttgagactgactttttggctgacaggcaggcattcctaccccctctcctctgtcacctgctctgacagttgcgtacacattcccaggacctatttccccatctgcaagagaaaatgattcccaaggcccttctggtataaacccaccagtgagatctcctggggacacccgctcctcgagtattcccatagggcttttctctctcctactctgctcccctccacctacaccccagcgctgcacagcccccgagtccttggcactcagtcaggcagaaggcaacaggctcatgccagaaacggccagtcaaggctggtcactgctggtcatggccaggtcagactggtcaagcctggtcaaagatggtcaaaacctgccttatactacacacgctcaacacagaacagttctggtcaccaaatgaggggatttttcacacattaacaagttttcctattatctgcagacaccggctggatgtcctacaattcagttcaattctatcactaactggagttagcatagatcccgcactttaagggtgcagtcccacaagactgcctcccaccccagaagccaatcttaagccccaggttttcacctgtacttctaactggctatcattcagggttcctatgactcttggctttgataatttgctaggagaactcacagaactcaggaaagaactcaggaaaaacttgttacatttaccaacttattatataatgaaggatatagatgaacggcccttgaagggatacatagggtgaggtctggaaggatcctgagtgaaggagcttctgtccccatagagttggggtgtgccaccctcctggctcataggtgtattcaccaacctggaagcattctgaaccccgtagttcagacatcatgggcaatgtcaggaggactagctcccaggcatcatgtgcctggttaacaggctggtaaacttcctctcctggccactctcaggcccagctagagggagagaagaacaagcctactggtctgcaggtttttctgggctacaggttagtgtttcctagaatccagtcttccaggtcaaagggattcctcctttcccgtaagagatcgttgtaaatcaggcatgtgagggatggcaggagtcctccacatccttttcagtgaccagtgaagtgactgacttgaatatactttgtgaaggaaagggtagtctatattctatcaggagctccctagggttgacaggggggagtgtcccttgaagttcagttctgtgcagggatgagcagagcagccagggctatgcctggccaccattgagcaggggccacacagagcagaggcctctgtttgggcgagactttgcagagatactgtcaatgttcctgatatggaaggagcctgctacaggaccgtccttacgtgtagggtagaacataaacttatacaaggaaaatgaaaagcaaaatatgttctcgtgtgtctatacttcctcatctaaatatctatctctacagggagcataggctggagtgtgcatagcagtcacagctcttgcaggggtgtgtagggtcagaagaatatgaggagatatacatcattctacacccattttgccatctgaatatttttcagcaagcgcttatattatggcagataatgaccatggcatgaatgtcagggcctagcatcctatctttcagttttgtctcttccctggtctctggccatgaccacaggcttagcagtctcccagcctttggccgtcctctcagtcttaggctcagcagcctctgctgttctaaacatattgtttgctgcaccccagaggaaagagcaaagggccatgagggggtcatgaggctcctctccacctgactttgaccctcagctggattccatgggaatgtgaggccactgggattttgaatttgtagggtccagccctatggggcttagcaggtgttctccccatgtgtggagacgagagatcataagaaataaagacacgagacaaaagagataaagagaaaacagctgggcctgggggaccactaccaccaagacatggagaccggtagtggccccaaatggctgggcacgctgatatttattgcatacaagacaagagggcagggtaaggagggtgagtcgtccaagtgattgataaggtcaagcaagtcacatgatcatgggacagggggcccttcccttttaggtagccaaagcagagagggaaggcagcatacgtcagcgttttcttctatgcacttatcagaaagatcaaagactttaagactttcactatttcttctaccgctatcttctaagaacttcaaagaggaaccaggagtatgggaggaacatgcaagtggacaaggagtgtgaccactgaagcacagcaccacagggaggggtttaaggcctccagacgactgcgggcaggcctggataatatccagcctgccacaagaagcttgtggagcagagcattccctgactcctccaaggaaagggagactccctttcgcggtctgctaagtaactggtgccttcctagacactggcattacagcttgaccaaggagccctcaagaggcccttatgcgggcatgacagagggctcacctcttgccttcttggtcacttctcacaatgtcccttcagcacctgaccctatacccaccggttattccttgattatattagtaatacgacaaagaataatattaaaagctaaggattaataatgtctatactaatgattgataatgtccatggtcatctctatatctaatttgtattataactattcttattctattttctttattatactgaaacagtttgtgccttcagtctcttgcctcggcacctgggtaatccttcacccacatgaattcacatagaagtcttcttcaaaatccctggcttcttttccccagaggatctgggaatgatgagaaatgagtggaaccagccaagcaggtgaaaggcattttcattgtgaaatatgacactgaaggtgagtgggaaggtcagtggaataacacatatgacactgaggctctgggtggaaagcatgaggttgcaattgagtgtgtgtttcctggagccacagtcccttagtttctgcactctccagctattaaaacactgtgtgtgttccttctctgctcctaagttgaccccactgtcatagcagtctttttcttaaatcgatttacactcattgtggcgttgtcaagacaactattcagacgcaagcagagctctattgcataaaggatgcagattcatctggaaaattagattcatgtctctttccacccccacatccacactccccactcatttctgtattaaaccattccagtcagagcagcccactatgtaaattcatcctgcattctaatcagcactgcccaaaaagctaagcggaaggaaaaagtacagccctagggcacaggatcacagagtaacagggacaagtatgttcttatgctcatccacccacaacctctacacctccagatcacccaggccacatctaccgcatctcaagcaagcacatgtccttctggaaagaagcaataaaatatgtggagctaaaagaatcatttaagtatttacttccaatatttaaaagggaagctggagctgccccagtctcaaaatttgaaggattccagagggccatatcccaaagctgagggtgagctgcgccctagagaaatgcagtagtcagggttctccagagggacaaagacaggaccaataaggtatatatgtatatatgtagcagggagtttattagggagaatgggctcacacgattacagagatgaagtcccaatctggggaataggaaaagccgacagcatagctcagtccaagcccaaacacttcaaacccagggaagctaatatgcagtccccagtctgaggctaaaggcttgagatctcctgggaggctgctagtgcaagtcccagagtccaaaggccaaggatcctggagatggctgtccaaggtaaggaggagaaaatggtatcccattcccaaatgtgggggggagagagagagagagagattgagagataggaagtccccttcttctgcttgatttgttctaactgcaccagcagctgattggatgataaccacccacattaagggggctcttcccctcccagtccactgattcacatcaatcgcctctggctacaccctcacaggcacacccagagacaatgcatcaccaggcacggaggcatccctcaacccagtcaaggtgacactaatattaaccatttcaggaaccttgggtgtgctcccaccttagcaagaaggagaggtgggttggcagtgaggctgaggcttggggtaatactctcacctcatgaaagtggcgaaacatgacaataatctctagaacagcagtcgttcaagacacacaaggatggtagatgggcaaaggctcattcaacaaaactccctgaaacagtaaattttccatggagcccaccacaccaaccgagaaccgagtgattaggtgagattgcttcattctacaagcaagagaacacagactcctcccactgatccttctttgggagtgtctgggcaatcaggtttactatatgggaagcagcagcgacatcaccaggtcatgtaggtcatgcttccaggaagatgtgatgagctagtagttccagaaaggaatccctggcaatcaccagttgagcttcttgccgtgcaggctgcaatgtaatgagcagtccaggcttttctataaggtgcctttgccacccttagtctgcataagggaccttgatcaaaaggtgatgcattgctggcatgtaccatgtctgtgttcatttctctgactttatccccatctttctagctctagtttttccttttgctggttctcccagccttatctggaagtttcagactcaacaccatgttttagtttgctgagcagaacagggacaacaacaaaagcccaaactgaagaaaggatattgaaaattcttccaattcattttgttgtgctaaagcctacattgtttttcgaacatttcacaggctctctcatgatttgtagaagaaaacatacaagaaacaagcatatgggtatcaggagatttttatcatgaaatataaaggagtgtattacacatgtgtatgttaatatatatacacaagggtgtgtgtgtcaagaaatagaacattacagcctcccaggtgcttcctgaggtctattcacactggctgctccttctaagtctgtcttcatttttattttaaacatattattaaatatgtatcagtaacataacatataaattatatgcacacttaaaacagtaactatggggcacacaccactacctaaagaacagaatacttcctgtaatttacaaactgctagtatgtcccttcctgaacacatcccattcaatcaaatctaaatgtacccctttcctgacttttgtaaaactctctactttgctttcattgatactttctacaatcttcatttgcacccctaaacactatcattttgcctactattaaactttttaacatgcaattatactgtttacttcttttgatttgcaacttttgctcactctaatgagggtcatttatcttgatgctagtagccataatttctttactttattgctgcatatatttcattctatgaacattccaaaatatcttaactagttctaacaatgaggaatatttctattgtttccagcttcagagtattttgaagtgatgctatgaacatagcaaaaaaccttcatattaaaggatctccatagatatttgagactttaattctctgtctgatgttttaaatgacacttagctttacaaatttttaaattttcttatacgtgtataaccgaaagtaagagagttttaacattttgacaaaaatatttaaagatcaaagaacaagcataacttttcctatggttattgagatcacatggtatggtttcaatttgcatggtcatttcatggtcctccagtaggtgcaaagcgaggactgcctgtactagtaaaactcctcctacctttttcttaatctttggaattcttgacctgcacatcactgtatcatagttggaatcaccttgtcaaatgccacacgaaaacgattgcttgggattttgtttgtggtcacatcgaatctttaaaatgattcagagagaactgacactattacaacatgaagtttcacagtcagtgaacaaagtacatttctctattaattgaagttatcatttattactatctgtattagtttgcaacccaacgtcatgtgcatatttctaggtatttgttacagcagcaccccacttctcagtaccagaatccattcatttgctatggctgccgtaacaaagtaccacagttggttggcttaaacaacacaaatatattgtctcacagttctggaggctagaagtccaaaatcaaggtgccagcagacttggttccttctaagggctatgagggaaggatctgtctgagacctctctctttggcttgtagttggctattttcttcgcatgtctcttcatggggcctttcctctatgtgtgtctgtctctgtgaccaaatttcaccttttaatgaggacactggtcgtactggagtaggatccatcttaatgacttcgtcttgctaattataccttcaatgactccatctccaaataaggccatattctgaggtactaggtgttacaacttcaacgtatgaaaggtggttgggaggggcacaagtcaaactataacaggagtatctctttaaaaatgttacaggtttcttttccatgtaggtctttactgtgtaagatttattctatgtactttcatccattatcaatttattgcctctctgcttagactgaatccttccatatatgctgtttgataaacaacgtaattccattaagcatttctcctttcaagtgagcatgatgaaagtgagctttttcagtagaggatggtggaggaacactgaagggaaaagaggcattccttccatttccagcagaggcagggtgagtgagtggtgtgggcaaggcgatcagttggagctatgccacaaccactggcccagaactcaaggtccctctgtgaccatgcagcctccatctggcaatgatctgtccacagtcgtcttaatacagaaaccagggccccggaggcttcctatccacaggagcaacagcgcaattcctctcaacactcccacactccaaggcctctcacctgggcctgtgcacgtgaaggcttctctcctggcccagagctctgattccctgtgcaggccctagcacacggcccccttgtggcctgaagggtccacactgagctgcaagccctctgcaaaccttccacacatctcgtgtgcagtacagggcacctgctgcctggaggggtcccaccctatctacccacccacatacacccaagccacccagctgctgatcatcacctccctgcctgcactctggaaggttgccttctgcttttccagggactgtaaaccagcaccagcctggctaaccagacaacttctctaccaaaccagtggactgaactacaacttatgccatgagagatccttccaactgtttccttccttgcgtactttcccctagccctatggtgtcatatcaaggttccataaatctcagagttgatcatagttgaattatttgtattaaacttatcctgtttaacctatgtagttcctatcttttgattagacccatgctgatttctgatggcattattattagtatattttaacttactcattctctgtcactcttttgccaatatattggtttgtaaatcttatatgtgtgtgttgatgtatgtatatgcatatacatatatcatctagtagtgatacttttgtctaacaatttatgtataagttattttgggttttctagtccataatcaaatcacctatcaataatgacagatttgtttcttcatttgtaattcttacacttttattattcttgccttactgagtaaattaagatctccaatagaatcaagggaaactatttctcaatctcaaaaaagaaagctttcaatatttcaaaatttagtggacatttattaaagttattaaagatgtccttcagttaagaaactttctttctcttcatagatatctgaaaagttttattatgaatgcagtttgagtttattggacacttttttactacatgtactgaaataatgatatgatttccatgctttggattaatatggtggaggacactaatttatttcttaatgatagaccgtcttggtcttgatatgttactttgttcatacattgttgaatttactttgctaatattttcttgaggattttccatctatttccatgagtgtgattgatctcttattgtcgtttatttttgtgtccatcatcatattcactttcaaaattttactacatgatataaataggaaaatgttctttttttctcatatattccttagaagactttgtataagattgggatcattttcttatttaatatttgatgagcttagaggatttcatttttggttttaattctttggggaaacttttttaaatgacccatttgtttcttttaataactataggtctattcttgattttcatattgtcttgagccaagtttgttatatttttcaagcatttgctaattcatctacactttcaaaaatattaccacaacgtatcacatattttctcatcatctttatcactgagacacattatgcatatacaaaatgtgaataatatataaatatgcatataaaatatgcatatacagtcctatatttcaaacagtgtatgctttctctttcaaatttaggtccatgcagaaggagtgtttttatgatgggacggaaaggcccagtttttccaagaataattatgaaaaagacaatttcccatggtctgcagtgctacaatgatcattaaccaagtgtttcacatacaaatgagtctgacttcacaccttgtcctttctcaaatgaagcttcatttgcttggacattaaattttatgtaaattttagaagtggcttatcaatttccacacaccaagaatacagaatttgttatgggattgtttttactataaaaatttcagaataggcatctttaaaatatataacattttagcctattaacttgaactatctcttcacttatttgtcccatttttactctccataacattctattgttttctagtgaaagatgattttatttttattagttatgcaaatgttttattattttaagtggcagaagaaaggtctgaggtccagaacctggtggacagtggggtgagtggaggtgggatagctgtgtgagggagagattactggataaggaaatactggatctgagaatggaaagataaaacctgtgcagatggagtgatgtcacgcagatggcagaataggtagtcacccctttgtatcctctcacaacacaaattctgcacccatccatggacaaaagtctctttgtgggaaccttgggattcaggtagaaggtgtaactcctcagtggtgtccaagacctaggaaggtcatttggccagtgcagacctgcacccaggtggaagatccccatgactgtgatcccaacttcagaccccaaaacaatcgtgtttcccaaggagcttggttacagccccatgtggccttgagcctggtaccaaaaccatccaacaaggggtccaggagaaatcatgcacactagtgccctggcagacaaacccatcttccccaaacactggtctcgacagtggacctgaaagttatcctgtagcttaattctagtcctcctcagatgtggttccagcttggtatgctataacaaggatccagagggacactttcccattggtgccaccagtttgggcttgccagcctctgtcccacagcagattctgaaggggtcctgtgggactccagcccctctctgccacagcctcagagttatcctgctcatgctgaaaactgctgggagactagcccatctgtgccactatgaaaagcttgcaagccttcacctcacagcaaagcctgaaaaccctgaatctcagctatagctcctttcagctgtggtttgtgaacaatcctagctggagagggatctgctgggagtctcatccactagtgccactgggtcaggcttgccaatattggtcccatggaagattctgaagtagccctgaagcttctttccagcccctcccagctgtagttcagaagcagttctgtccagctatggtacccccaggagacatacctgtctgattctctgtggcaggattgccaacttctgtctcacagcagatcctcaaattaccctggatctcagtcccagcatttctcatctctggactaagagcagttctgcccacctggggacccgaggggaggcttctccaacagtgcctctgtaggcagatggtctgacctttgtcccattttgtggatcttaaaatggcccaataaattgggtccaggctttctcatctgcagcttgacagcaagtttgcttacccaggatatcaccaggacacacacctatccatgaccctgaagacaggcctatagatctcagttttggctgtggatcctgatccaatctgggtctcagtttcagcccatcttagccacagaccggggcagtatggttagtccagtgacccattcggtgatccaacagaaacctctcagagacctggagaaagccacaccagtcagcacatttggaagtaggcccaacatttgccaaccctgaagccaacatttatcccagcaccagcttcatagatcaaagtcttagacacagttcagtccactcaggggccagacaaaacccacacctgctacagcccctggtaagagacctaccaactgtggtgtttactgtgaacatagcattagccatgggacttggattctacccccctcagtgcaatcctggaggctatcccatcagcccagagacgtaacagaagattttaccttgccaaaccagtctgtaaagaccgaaggaggggtttgggcctccaaatgtgcagatactaacacaaagctatatggtaacaaagaataaggcaaacttgacaccaccaaaggaaacttatgaagttccaataatcaaccccaaattaataaatatatgcaaattatctgaaaaagaattcaaaataattatcctaaagaatctcaatgagatgtgtgaaaacccagatagacaactaaatggaatcaggaaaacaattcatcaacaaaatgagaagtgtcataaagaaataaaaagccataaaaagaataaaacagaaatcctggagctgaagcatacaatgacaggactgaaaagatgcaatagtttcagcagcagactcaatcatgcagaagaaagaactagtgaacttgaagatacctatcaataattactttaaatgtaagtggattaaattatccaatgaaaagacaaagagtagctgaataattttttaaaaaaaacaagatgctgcctacaagagactcactttagccttgagaatacacatagactgaaagtgaaggaatgaaaaaagatatttcaggcaaattttaagcaaaagagagcaggagtggttatgtgcttatatgatacaaaataggctttaagttgtcattcaccattatcaagtgggacttaacatctgtgatgcaaggatggttcaacatatgcaaatcaataattgtgatacaccatattaacaagataaaggaaaaaatctatataatcatctcaatagatgcagataaagcatttgaacaagattcaacacgctttcatgagaaatactctcaagaaattatgcatagaaggaacgtaccttcacacaataaaggtcatatatataaaaagcccactgctaatgtcatatttaatcatgaaaagttgaaagttttccctgtaagaccagaaagaggacaaaagtgcccacgctcaccatttctacttaacatagtactggcagttctagccagaacaattaagaaaaagaaataaaaggcatccaaataagaaaggaagaagtgaaactgtctctgtttgctgatgacataatcttatgtagagaaaactttaaaggctccaccaaaaaactgttagaagtgatcaggaattcagtaaaacaggcaggatacaaaatcaatagacaaactcagtagtatttctttacactaacaattaactatgggaaaaaactaagaagtcaatctcattcacaatagaatcaaaaagtaaaaaataaagtagttaggagtaaatttaaccaggaaagttaaagatttctgtactgaaaactataaaacaattactagtaagaaaacatagaagaaaagctgcacaacattggtctgggaaagatttcttagatatgactccaaaagcacaagcaacaaaaccaaaaataaacaaatgggatggcatcaataaaaagcttctgcacagcaaagaaaacaattaatagagtaaaaagacaacccatgagttgggagaaaatatttgcaaaccatacatctaataaagggctaatacatacaacaggtaagaatctcatacaaatcaatagcatgaaaagaacaaacccaattaaaaaagggcaaaagaccatttctcaaaaaagacatataaatggccaaaaatatgttgaaaaaatgctcaacatcactaatcatcagagaaatgcaaatcaaaaccacaatgaaatatcacctcagcccagttagaacggctatttttaaaatggccacttttaaaaagacaaaaaaaaaaatgctggtgaagatgcagagaaaagggaactcttacacattgttggtggaaatgtaaatttgtacagccattatgaaaaacagtacgacggttcctcaaaaaattgaaagtagaactaccatgtgatccatcaatctgatttctgggtatatatccaaaggaaatgaaattagcatgtcaaagagatatgtgcactcccatgttcattgcaggattattcacaatagataagatatggaagcaatctaggtgtctgttattgaatgaataaagaaaacatgggagatatatatatatacacacacaaacacagtggaatactattcagccataaaacagaatgaaatcctgtcatttgtggcaaatgggtcaatctagaggacaacatgaatggaattgtagaacattattctaagtaaaataagccagacacagaaaaacaaacaccacataatgtcactcatctgtggaatctaaacaagtcgattttataggaatagagaatagaatgtggttaaaaaggctaggggagagggtggagagggaaaggggagttgttgatcaaagggtacaaaatttcagttagaaaggaggaataagctctagtaatctagcacagaatggtgactataataaataataatgcattgcatattataaaattgctaaaagatcatattttaaatgtttttaccacaaaaataatacgtgaggtgatgggtttgttaattagcttaattattcaacaatgtaaacatatatcaaaacaccaaattgtaccccacaaatatgtaatatatactgttactatttgtttattaaaaatgtttttaaaatctgcaaagatgcttccaatagagaaaaaagcacaggtgaagacatggaggtctatgaaagaggagtaggggagccacattgtggcatgcagctgctcatcaatgtgtagattttaaaggagaatgtgtggattttaaggttctaattctggctcctcatattctccatctgggatttcatatttaataccaagtgactaaaaattattaaaaatttgacaacctgtgtcatcttgaacatggtgagcaatgagaacactttcagttggaggtaatgcacaatggaacaggcacattggagattaggcagtattgagtggaacaaaacatgcaaattaaataaaatgttcaaatattcattgatgttgggatgctacttctgtatactgccctttttaatgctccctagaccctcattctttttcctcataactgactttgaaacaaactacctacaaacacattgtttcatggtctgtttttagtggtaacataggctaagacaagctaaaaatctcatcagtagaaatacagataaaaattattctatggatattttaaatgaaaacttattcagcgattaaacagaattgagcatatttacaagtatcttcatagttaaatctcaaaactatgatgttaattgaaagagaatatttttgaatgagagtctattgtttcagggaaaatgggaagggaagagaaaattcagaaatcactctacagctgacaaggtgttattaatatgagagggctagatggatatattactaagagaaaggaaaacgtgcagaattgtgtgtaagtatgttatcatctctgtctaataaaagcagaaaaatggagaatttgtgtttgcaaatccttgcaaatgctggtaatttcaagagaaggatgtgtaaaaatggatgagccatagatgcctacaagaaggaagaagttgggggacaagatagtaaaagaagtcttgtattcactcactattctttttacattttgattttttgccatgtgcatgttgcaaacatttaacgtgaataatatttcaaaaataacatttatactttgctcctaatattataacttttctctccctcttcttttctgctccattcctctgtaggtatatatgtagacagagatttgggaaataaaaatggaaattacaaggtgttattactggttacttccaggtgagagggggctttggaataatcgctgcattccttcattttttttttttttttttactttctatactgctggaattttgtgtaatgaatatctcaaatttgcaaaacaccaaacaatataatctgtaagtgaaataattccgaggattcttggatcaccaccattattcgtacccctgtggaataggcccagatccttatggactcaaaatacactttaataataaaatcctttagcatataaaaaatttaaagtatatttgttaaaatgcaaaatacacacagaacaatacaacacacataacacttttggataaatatttaaatatttcctcttgaggtcaggaacaacacaaggattctgtcattgttcatatttagcattgtattggagatccaaggaaaagaaataatacattaaaaataaatacaaggggaaagtgttgaaaagacaaaactaacatcagtatttgcaaatgatacgattgtgtacataaaaaatagaaaagcatctgcaaattgttagatttttttcagctgtattgaggtataattgacaaaattatatatatttaaggtatgtaatgtgatgattcgatatatgtatatattgtgaaatgattatcacaattgtgttagtctgttttgtgttgctctaaaggaatacctgagactgggtaatttataaagaaaatggtttatttgggctgatggttctgcaggctgtacaggaagtgtggtggcagtatctgctgcttgtgaggaccttaggaagcttccaatcatagtagaaaatgaaggagtaggcatggcccagggtgagagcaggagtgggggctgggggaggcgccacactcttttaaacaaccagatgtcacacgaactgcaataatgagaactcactcatcaccaaggggatggcactaaaccattcatgagggatctatccccatgatccaaacaccttccaccaggccccacctccaacacgggatgatatttcaacatgagatttgaaggggacaaacaaccaaaccatattattacattcctagacccccaaattttaagtctttctcacattgcaaaatacaatcatgccttcataatagtcccccaaagacttaacccattccagcattacttcaaaagtcccaagtcccaagttccacgtccaaagtctcatctggagatgagttcctttcacgtatgagcctgtgagataaaaaacaagttatttactcgcaagatacaatagtaatataggcattgggtatacattcccatttcaaaagggagaaattggccaaaagaaagaggcaataggcatcacataagtctgaaacccagcaggacagtcactaaatcttacagctccaaaacaatctcccttgactccatgtcccataactaaggcacactggtgtaaggagtagactcctgaggccttgggcagctctgctcctgtggctttgaagggtgtagccctcatggctgctctcactagtaggagatgagtgtcttcagcttttccatgctgaggttgcaagctgctgatagttctaccattcttgggtctggagggcagcagccctcttcccacagctccactaggcagtgccctggtggggagtctgtgtgagggctccaaacccacatttccccttggcactaccctctgtagggggccatctcttgcagcaggcttctgcctgggcacccaggcttcctcataatcctctctaatctaggtgggagctgccaagcctccttcactctggcactctgtgcacctgaagacttaacacaacatggaagccaccaaagcttatggcttatgccctctggagcagtagcctgagctgtacctacagccctttgaaccacaagtcaagccagagaggctgggatgtgggaaacagtgtcctaaggctaagcaattcagcggttccctgtgcctggctcctgaaaccattccttctcctaggtctctgggcctgtgatgggaggggctgcatcaaagatttctgaagtgcctttgaggcctttttcccattatcttggatattagcacttggctcccttttagtcatgctaatctctttagcaagtggttgcaccacagcctgatggattctttctctaccactgggccagactgcaaattttccaaacttttacattctgcttaccttttaaatatgagttccaactttaagtcctttctttgttcccacatctgagcataggctgctcaaagcagccaggtcacattttgaattctttgctacttagaaatttcttccaccagatatgcttcatcatcaagttcaaacttccacaaattcctacagcatggacacaatgcagccaagtcctttgctatgatataacagggtgacctttgctccagttgccaataccttcctcttttccatctgagagctcatcagcctggccttaactgtccatatttctatcagcattttggtcacaaccacttaagtctctaagaagttccaaactttccctcttcttcttgccttcttctgagaccttcaaactcttccagcctctgcctgttatgcaactgcaaagccacttccacattttcaggtatctttatagccataccccactcctattggtaacacagtaccaattttctgtgttagtcctttttgcgttgctataaaaaaatacctgagactagtaaatttatcaagaaaagtggtttttcttggctcatggttctgcaggtgatacaggaaacatgttgctggcatctgcttctggtgagggtttcaagaagcttccaatcatggtggaaggtgaagaaggacatgtgtcacatggcaatagcaggagtgggaggtgtaagtgccacactcttttaaacaatcagatctcatgtgaaccacaagagtaagaactcaatcatcaccaggggaatggtgctatgccatttgtgaggaatctgcacccatgatcaaaacaccttccaccaggccccacctccaacactgggggtgacatttcaacatgagatttgatgggaacaaacatccaaaccatatcaacagtcaagcgagttaacacatccaccacctcacgtagtcacctttgtgtgtgtgtatgtgtgtgtgtctagtgagaacacttaagatctaccctttcagcaaatttcaagtatacaatacattgttatcaactatagtcaccattctgtacattagaactctaaaacttattaatcttataacctaaagtttgtacttgttgaccaatatctctccattttctctacccctccaacccctggcaactaccattctactctctgtttgcatgagtttgactattttagattccatatatatgtgagatcatactgtacttctctttctctgtgtgactcatttcactcagcataatgcctgcaaggttcattcatgtcttctcaggtgaagggatttccttattttaatggctgaataatattccagtatgtgtgtgagtgtgcatgtgtgtgttcttgtgtgtgtactgttggccacccatatccatatgcttcactttcatttattcaactgagtagggatttaaaatatatgaaaaaattatatgtgtacttaatgtgtacactatttttcttgtcattccctaaacaatatagtataacagccatttacacagcatttgcattgtgttaggtattacaagttttataaataatttagagatgatttaaactattgatatataggtagatgtggataggttatatgcaaatattatgctgttttatatgagagacttgagcatccatggatttgggtatccataggtggtcctggaaccaatcccttacggataccaagggactactatatatacatgttttcatgtcctagctactgtgaataatgctgcaatgaacataagggtgcagaaatcacttcaagatagtgatttcatttcctcatatatccagaagtaggattgctgggtcaactggtagttctatttttaatttttttgaaactttcatactgttttccataatagctgtatcaatttacatttccaccaatattgcacaaagtttcacttttttccacatcctcaccagcatttgttatgtattgtcttttcaataatcatcttaagaagtgagaggtgatatctcattgtggttttgatttgcatttccctgatgattagtgatgttgagcatttttcatgtacctattagccatgtccctgtttgtatgtcttctttgggaaaatgattattcccaaattattattatggactactttattagtccattttcatgctgctgataaagacatccccaagactgggcaatatacaaaagaaagaggtttaattaacttacagttccacttggctggggaggccacacaactgcagcagaaggtgaaaggcatgtctcacatggtggcaggtaagagaagagggcttgtgcaaagaaactcccctttgtaaaaaccatcagctctcatgagacttattgactatcatgagaacaacacaggaaggagctgctccaatgattcaattacctcccactgggtccctcccataacacatgggaattcaagatgagggttgagtggggacacagccacaccatatcactccaccccggcccctcccaaatctcatgtcctcacatttcaaaaccaatcatgccttcccaaccgtcccccaaagtcttaatttatttcagcattaactcaaaaatccacagcccgaagtctcatctgagacaaggcaagtcccttctgcctatgagcctgtaaaatcaaaagcaagttagttacttcctagatacattgggggtacaggcattggataaatacagccattccaaatgtgagacactggccaaacaaagggactacaggccccatgcaagtccaaaatccagcagggcagtcaaatcttaaagctcctgaatgatttcctttgacttcatgtcttgcatccaggtcacgctgatggaagatgtgggatcccatggtcttgggcagctctgcccctgtggctctgcagggtacagcctccctcccagctgctttcatgtgctagtgttgagtgtctgcggcttttctaggtacacattgcaagttgtcagtggatctaccattctggggactggagaatggtggccctcttctcacagctccactaggcagtgccccagtagggactctgtgtgggggctccaaccccacatatctcttccccactgccatagcagatgttctccatgagggccctgcccctgcagcaaacttctgcctggacatccaggagtttccatacatcttctgaaatctaggtggaggttcccaaatactaattcttgacttctgttaactcgcaggcttaacaccacatggaagcggccaaggctttgggcttgcaccctctgaagccatggcccaagctctatgttggcccctttcatccacggctggagcagctgggacgcagggcaccaagttcccaggctgcacacagcatggggaccctggccccagcccactaaaccacttttttcttctaggcctccaagcctgtgatgggaggggctgccatgaagacctctgacatgtcttggagacattttccccattgtcttgggaattaatattcagctcattacttatgcaaatttctgcagagggcttgaatttctccctagaaaatgggattttcttttctattacattgtctgggtacaaatttttcaaacttttatgcactgcttcctttataaaactgaatgccttcaacagcacccaagtcacctcttgaatgctttgctgcttagaaatttcttccacctctctcaagttcatctctctcaagttaatctctctcaagttcaaagttccactaatctgtagggctctttgctaagacataacaagagtcacctttgctcccattcccaacaagttcctcatctccatctgagaccacctcagcttggatttcattgtccatatcattaaaagcattttggtcaaagccattctacaagtctctagggagttccaaccgttcccacattttcctgtcttcttctgagcccttcaaacggttccaacctctgcctgttacccaattccaaagttgcttccacatttggggcattttttcagcagtgctccactctactggtaccaatttactgtattagtccattttcatgctgctgataaagacatacccgagactgggcaatttacacaagaaagaagtttaatagacttacaatctcaagatgagatttgggtggggacacagccaaaccatatcaggtactttgcccatttttatttggattatttgttcctttttggtattgagttgtatggattccttatgtattttggaaattaacttattatacatgtgattgacaaatattttctcacattctgtagacttttcattttgttacttggtttctttgctatgtagtttagttttgcttttgttgcctgtgcttttggtgtcatattcaaaaaatcattgtcaagaccaatgtcaaggagctttaccactatgttatctttcaaaagttttatggtttcaggtcctacgttaaggtctttaattcatttcaagttaatttttgtaataggagaccaatttcattcttttacatgtggatatgcagttttcccaacaccatttattgaagagactgtcctttccccaatgtgtatttttggcatgcttgtcaaatattagttgatcacatatatgtgggtttatttccaggctctcagttctgttccaattatctatgtgtctgtttttatgccaggaccatacattttgaatgctatggatttgaaataaagtttgaaatcagtgtcatgcctccagtttattcttcttgaatctgtatattgctttgggtagtatgaatttttatcttaatgtttttatcacatcactcttacaagagtaagagtttttatatgttgattttgtatcttgcaactttactaaattattttattatcactaaaggtttgccattctaaaaaatctttggctgggcatggtggctcacacccataatcctagcactttggaaggcctaggcaggaggacaacttgaagccaggagttcaaggtcagcttgggaaacatgatgaggccctgtctcagaaaaggaaaaaagaaaagcagaaatcattacaaaataaaaatattttccaaaaaccaactcttaatttcattcatcttgtctattgttttttagtgcctactctatttatttttgctctaattgacattattttattcactttgtagatgttgaggttagtttattctttttttatagttctttgaggtataacattaatttgttcactggggatcttttttcttattgtaatggtttatagctacagattttcctcttagaattgctattgttgtatcccataagtttttgtatgttgtgtttctattttcaattgtcttaagatattgtttgattttctctttgaattcttatttggcccactggctgttcaaaggtgtttaattttcatgtatttgggatttttccaaattcctcctgttattgatttatagttttatagcattgcggtcagaaaatatacctgatatgattttaatcttcttgaatttaatatgagttgctttgtggcctgttgtatgatgtatcctgagaacatttcatgtttgctttagaaaaatgtatattttgctgctgttagatgaaatgttttgtgtatatctctggttcattcgatctatagcattatttccttcttgattttttgtctgaactgcctagtcattgtggagagtgcagtattaaagtcccctgctattattatatttctatttacttctcatttcaattatgccaatatttgctttataaatgtagatgctctaatgttaggtgcataagtattttaaatttttatatcatttgatgaattttccctttattattatataactatcttgtctcttgtgacactttttgaataaaaaggctatttttttctggcataattatacccacctctgatctcttttaggtaccaattgcatggagtatgtttttctatcccttctctttcagcctatgtgtgtctctaaagctaaattgagtatcttgtacatagtatatttttgtatcctgttttttatccattcatcattcagtgtcttttgattgaataacttaatccattgacatttaaatagctattagacgtaaacaacttactattgacattttattcattgttttctgactgttttgtagttcctttgttactttctttctttcttcctttgtgatttgatgactttgtggtagtatggtttgattcctttctctttatctttttcggtatccactacaggtttttttatgtgattgctatcaggtttatattaaatatcttacagctataacatcccattttaagtggttaacaacttaatttatatcacatacaaaatctctatatttttacttcttctttatcacattttaggttattgatgttacaatttatgtcttttctatattatatacccaataacaaattatcatagttattatttttaacgttcatgtttgggtgtttttttttttttgagacagagtctcactctatcacccaggctggagtacagtggtggaactcagctcactacaacttctgcctcccaggttcaaacaattctcatgtctcagcctcctgagtaactgggaatacaggcgtgtgccaccacccctggctaatttttgtatttttggtaaagatggggtttcaccttgttggccaggctggtctcgaactcctggcatcaagtgatccatccacttgtgcctctcgaagtgctggtattacagatatgagccactgcgcctggacttaatgtttgtttattaactattatactagaactgaaagtgatttactcatcatcattaaaataatagagaattctgactttgactatatatttacctatataagtgagttttatgcatttacatgtttgtatgttgttaattagcatccattcatttcagtaaagaactactttagcatttcttctaaggcaggactagtggtgacgagctcccttaccttttgtttgtttgggaaagtctttatatcttcttcatttctgaaggacagtgttgccaggtaaagtattcttcattggcagtttttttctttagatattttaaaaatatcattccattccctcctcctggcctgcaaggtttgtgctgccatagaatttttctaagtattgcctttagaaaggttatcagatacaaggtcaatatacagaaataattggttaataattgtattctcaaaatcaacacacacactccatggcatttatatacaccaacaggaaacatctgaaaaagaattaagaaaggaaactcacatacagtagccacaaagaatacaaaatacctagttatcaatttaaccaaagaagtggaagatttatacaagtaaaggtataaaacactgatgaaaaaattggagagcacactacaaactggaaagatattccatactcatggcttggaagaattaaggttattaaaatgactatagcactaaaagcaatttacatactcagtgcaatcactataaaaataccaatgacattcttcataaatagaaaaagatactaaaatacacatggaattgcaagagacctcgaatagccaaagcaatcctgaacaaaaagaacaaagctggaggcatcacactacctgacttcataatatactacaaagctgtaataaccaaattagcatggtactggcaaaaaacaaacaaaaaacacaaaacaacaacaacaaaaacagagacacagaccaatggaacagaatagagaatccagaaataaatccacacatttacagccaactcattttcaacaaaggcaccaagtgcatacattgagagataggacagtctcttcaataagtgatgtgaggaaaactagatgaccataggcagaagaatgaaactagacctcctgtctcttattacgtaaaaaatcaactcaaaataaattaaatatttaaatctaagacctgaaaatatgaaactaataaaaaaaactttggaaaaatccttcagaacattggtctgggcaatgatattttgtgtaagacctcaaaagcacaggcaactgaagtaaaaatagacaaatggaatattatcaagctaaaaagcttctgcacagcaaaggaaacaaagagataaatcatggaattgaaaatattttcaagctttccatcttacatggatttataaccagaatagataaggatttcaaagaactctgtagcaaaaaaaaaaaaaaagttttaaaatgcgtaaaagatctcaatagacatttctcaaaagcatatacacaaatggacaatatgtatatgaaaaaatgctcttgggatctttgtcatgaaatctttgcccattcctatgttcagaatggttgcctaggttgtctcgcagggtttttatagttattggttttaattgacaaatgggatctaattaaacttaagagctactacatagcaaaagaaactatcaacagagtaaacagacaacctacagaatggaagaaaatttttgcaaactatgcatctgacaaaggtctaatatccagaatctataaggaacttaaagaaatttacaagggaaaaacaaaaaaaaaatttaaaaatgggcaaaggacatgaatagacacttctcaaaagaagacctacatgcagccaacaagcatatgaaaaaaagctcaatgtcattgatcattagagaaatgcaaatcaaaaccacagtgagataccatctcacaccagtcagaatggctattattaaaaagtcaaaaagtaggtcgggtgtggtgactcacgcctataatcccagcactttgggaggctgaggtgggcagatcacaaggtcaggagatcgagaccatcctggtgaacactgtgaaaccccatctctattaaaaatacaaaaaaattagccaggcgtggtggcaggcacctgtagtcccagctactcaggagactgaggcagaagaatggcatgaatcaggggggcagagcttgcagtgagtggagatcgcgccactgcactccagactgggcaacagagcgagactctgtctcaaaaaaaaaaaaaaaagagtcaaaaagtaatggtagcaaggttgtggagaaaaagggacacttatacactgttgatgggagtgtaaatttcaactattatggaaagcagtatggcaattcctcaaagagctaaaaacagaactatcattcgacccagcaatcccattactaggtatatacccagagaaatacaaatcattccaccataaagatacaggcacgtgtatgtccactgcagcattattcacaatagcaaagacatggaatcaacataagtgcccatcagtgacagataagataaagaaactgtggtacatatacaccatggaatactatgcagccataaaaaaatgagatcaggtcctttgcaggaacatggatggagttggaggctattattcttagcaaactaacacaggaacagaaaaccaagtactgcatattctcacttataagtgtgagctaaatgatgagaactcatgatcacaaagaagggaacaacagacactggggtctacttgagggtgggaggagatagaggagcagaaaagtaactattaggtactaagccttgtacctgggtgatgaaataatctgtacaacacacccccagacatgagtttacctatgtaacaaacttgcacatgtaccaccaaacctaaaataggagttttttaaaaaagaaaactaaagaaattgagtgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagcatgatgcctccagctttgttcttttggcttaggattgacttggcaatgcgggctcttttttggttccatatgaactttaaagtagttttttccaattttgtgaagaaagttattggtagcttgatggggatggcattaaatctgtaaattaccttgggcagtatggccattttcacgatattgattcttcctacccatgagcatggaatgttcttccatttgtttgtatcctcttttatttcattgagcagtggtttgtagttctccttgaagaggtccttcacgtcccttgtaaggtggattcctaggtatttgattctctttgaagcaattgtgaatgggagttcactcatgatttggctctctgtttgtctgttgttggtgtataagaatgcttgtgatttttgtacattgattttgtatcctgacactttgctgaagttgcttatccgcttaaggagattttgcgctgagacaatggggttttctagatatacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatggtattggctgtgggtttatcaagatggattaaagacttaaacgttagacctaataccataaaaaccctagaagaaaacctaggcattaccattcaggacataggcatgggcaaggacttcatgtctaaaacaccaaaagcaatggcaacaaaagtcaaaattgacaaatgggatctaattcaactaaagagcttctgcacagcaaaagaaactaccatcagagtgaacaggcaacctacaaaatgggagaaaattttcgcaacctactcatctgacaaacggctaatatccagaatctacaatgaactcaaacaaatttacaagaaaaaaacaaacaaccccatcaaaaagtgggcgaaggacatgaacagacacttctcaaaagaagacatttatgcagctaaaaaacacatgaaaaaatgctcaccatcactggccatcagagaaatgcaaatcaaaaccacaatgagataccatctcacaccagttagaatggcaatcattaaaaagtcaggaaacaacaggtgctgcagaggatgtggagaaataggaacacttttacactgttggtgggactgtaaactagttcaacccttgtggaagtcagtgtggcgattcctcagggatctagaactagaaataccatttgacccagccatcccattactgggtatatacccaaaggactataaatcatgctgctataaagacacacgtacacgtatgtttattgcggcattattcacaatagcaaagacttggaaccaagccaaatgtccaacaatgatagactggattaagaaaatgtggcacatatacaccatggaatactatgcagccataaaaaatgatgagttcatgtcctttgtagggacatggatgaaattggaaatcatcattctcagtaaactctcccaagaacaaaaaaccaaacaccacgtattctcactcataggtgggaattgaacaatgagaacacatggacacaggaaggggaacatcacactctggggactgttgtggggtggggggaggggggagggatagcattgggagatatacctaatgctagatgacgagttagtgggtgcagtgcaccagcatggcacatgtatacatatgtaactaacctgcacgttgcgcacatgtaccctaaaacttaaagtataataataataaataaataaataaaagaaattgagtgaaacccaaataagctaaactcagagaaagtcacaccatgatgcatcttaattaaccttctgaaagctaagacaaaataattaaaaacagctagagataaatggcattacctataaaggaacaataattcaaaagacaatgggtttcttatatgaaattatggcagccagaatgaaggagaataacatttttaagtattgaaagaaaagaatagtctacccagtgactatccttcaggaataactagaaaagaaagaaactctcaaaggcaaactaacagactctagttacttataagaactatcctttaagagtagctaaagcagccattccaaattgaaatatatatatataaataaaaggatgatggtggaattggtaaaaacagaagtaaaaataatagactatacttcctctaatcaatttctttaataatattttatggttgaagcaaaaattataacatcatctaatgtggtgctcagtgtatgtactgcaaatacttatcacaattgtatttggaaagtggggaggttaatgtgacataaaagatgtaaggtttctatactttaccagaagtggtaaaatatcaatactagtaggctgtgatatgatgcacatgtaactcaagtgcatatggcaatacataaggtaaatagtaagaaaataggaatcaatatactcaaatattataaataaaaatagaggtctataaactgttcatgtagtctagaggaagacagcacaaaggaaccaaaaaattagaaacaaaggaattaaatagaaaaaaataataacatggaacacttaagccttaacgtattaataactatattaaacataaatagtcaagtacagcggccgggcacggtggctcacgcctgtaatcccagcactttgggaggccgaggcgggcagatcacgaggtcaggagatcgagaccatcctggctaacacggtgaaaccccgtctctactaaaaatataaaaaattagccaggcattgtggcaggcgcctgtagccccaactactcgggaggctgaggcaggagaatggcgtgaacccaggaggcggggttgcagtgagctgagattgcgccactgcactccagcctgggcgacagagtgagattccatctcaaaaaataaaaaataaaaaaaggtcaagtacaacaaatacaatacaaagattggtagagtagatttttaaaaatacacctctatgttgtctacaacacactgatttcaagtgtaatgaattaggtagattaaaaggagaaggaagaaaatatatctcatgcaaacattaatcaaaaaagttaagtgtggctttatcaaaatcagacaaagtaaatcttagggtaaagaaatgactacaattggaggtacaattggagatactatatgatatggtttggctctatgttcccacccagatctcacctggaattgtagaattgtaataatccctatgtgtcatgggacagacctggtgggaggtaactgaatcatggaggcaggattttcccatgctattctcgtgatattgaataagtctcatgagatcttatggttttataaagggaagttcccctgcaaacacttgctcttgcctgccaccatgtaagatgtgactttgctcctcattcaccttctgccatgattgtgaggcctccccagctatgtggaactgtgagtcaatgatacctctttcctctataaattacccagttttgggtatgtctttattaccagagtgagaacagactgatacagtaaattggtactggaaagtgggatgctgctgtaaagatacccaaaaatgtggaagcgactttggaactgggtaataggctgaggttggaacagtttggaggactcagaagataggaaaatgtgggaaagtttggaacttcctagagacttggagggctcagaagacaggaagatgtgagaaagtttggaacttcctagagacttgttgaatgactttgaccaaaatgctggtagtgatatggacaataaggtccaggctgaggtggtctcaggtggagatggggaacttgttgggaactggagtaaaggtcagtcttgctatgcaaagagactggcggcattttgcccctgccctagagatctgtggaactttgaacttgagagagatgatttagggtatctggggaaagaaatttctaagcagcaaagcattcaagaggaagcagagcatttggaaaatgtgcagcctaacaatgcaatggaaaagaaaaacccattttctggggagaaattcaaaccacctgcagaaatttgcatatgtaacaaggagccaaatgctagtcaccaagacaatggggaaaatgcctccagggcatgtcggagacctttgtggcagcccctctcatcacaggcctgaggtctaggagggaaaaacggtttcatgagccaggcctagggctcccctgcgctatgcagcctctgaacatggtgccctgcatcccagctgtttcagttccagccatggctaaaaggggccaatgcttcagagaatgcaagccccaagccttggcagtttacacatggtggtgggactgtgagtgcacagaagtcaagaattgaggtttgggaacctccacctacatttcagaggatgtatgaaaacacctgaatgtccaggcagaagcatgctgtaggggcagggtcctcatggagaacctctgctagggcagtgtggaagggaaatgtggggtcatagcccccacacagagtccctactgggccactgcctagtggagctgtgaaaagagagttgccatcatccagaccccagaatggtagattcactgacagcttgtaccatgcaactggaaaagccacagacactcaacaccagcctgtgaaagcagccaagagggaagctataccctgcaatgccacaggagtggagctgcccaaggctgtggcagcccacctcttgcatcagcatgacctgggtgtgagatatggaatcaaaggagatccttttggaactttaaggttgaatgactgtcctattggatttcggacttgcatggggcctgtagccacttcattctggccaatttctcccatttggaacaggtgaatttacctaaagtctgtaccccattttatttaagaagtatctaacttgcttttgattttacaggctcataggtggaagggacttgccttgtctcagatgagactttggacggtggacttttaatgctgaaatgagttaagactttggggaaatgttgggaaggcatgattggttttgaaatgtgaggacatgagatttgggaggggccagggatgaaatgatacagtttggctctctgtccccaatcaaatctcacctggaattgtaataatccccacatgtcatgggagggacccagtgggaggtaactgaatcatgggcatgagtttttttccctgctgttctcatgatagtaagtctcatgagatctgatggttttataaaggggagttcccctgcaaacacttgctcttgcctgccaccctataaggtgtgactttccacctcattcagcttctgccatgattgtgaggcctccccagccatgcagaactgtgagtcaattaaacctctttcctttataaattactcaatctcaggtatgtctttattagcaatgtaagaaaagacttgtcttctgccataagatgagcctcactagatgctggtgccatagcttccggaactgtgagccaaacagagttctttttttttttttttttaactacctagtctgtggtattctgttatatcagcagaaaaccgactaagacaataattaactaagagtgtctaactgatatttttagaatattgatatgaaattcttaatgtaactactgattatatgaaaagtataattcctcatgaccaactgagatttatccaagagacacagagatagaattacagtaattgctatccatggggtatattaaaaataattttcttaacagatgctgatatagtttgataaaactctttagcaaaggattcttcttaaaataataaaatgtatgaataggggaaaacaatcttctcaacaaagcttctgatgttacacttaattgtgaaacaaataaccaaaaaatgtacttaattataaagtactgggggcagtttcagaaaaataagagagttaacaaagtcattggaatgtaatagtgtgaaagttctggtcattataatgcagcatgaagcagaaataagagttataacccctagaaaaatggacatataattattatttacatatgatatgattatattcctagaaaaagcagtttaaacactattaaaataagtagattggctagataaaagataagctaataaaaattaattactttgctatgttatcagttggaaagtacaaaaggaattctttcaaagtttggatgcaacattccaccttaagccaaatatagttaattccttttccctttgaactagcccctgaaattatcaaagaaatgtaaaaatccacttcagctctggaaacaagtgcagggtgttacccactggccagagcaaatttcttcaggttaatgagcagctgagacctaagggtggatctagccagctggggaaagaccaatccacttaggaaaacaagtgtaaggaacctacaccagcgtggaaggctgcagggtagaactgaggaaaggcatgagagaatgggtgaagctaaacctcgagtctcttgtcagctttgggatgtacattagggtaagaaattgccacctcaggagtcagtgcagcttctcattggcttgaaaagctggagcatgaaccctaatgattaaaggagagggcaggctctaagtatctctaggctgccccctctacagtgagtaagcagctgggaagagtaaaaacacagcaaacccatatttactccttctctcattatctggtattgaaatatttgaatagggactccaataaatcaaagtccatcttaattccccatactgaaccatattttgtaaggatgcgcaaaaagagaaaatgattggtaatttggcaggaccaacatgggaaccaatgggaataaaagtaaacatttctttgtgaaagatgttaattcaagaaacaggcggaaatttaaaataatctcttacttgtttttaacacaagctttgagaggctgttgcatctatgaagaaggcaggaaatactgatttcaaataaaaacataattataaaatttaaaatgcaatggaagcaatgaagagccgataatctcttaatcttaaaatttcatctgaaatgcttcagaattcacttagaaatcagaaaacaaaaatgaaagaaatgagattagaaaaacagtaagggacacagagagtacactggagggaaacaattatgcatagcactaactctgaaaaggaaagcagaacagagggtaggcaactaaaaaaaaaaaaattaaaggaaaatttccctgaaccagacagaggactgtctttagattggaagctttcagcaattatggaaaaaatctctaaatatacaagtattctgatatgggtattttttcttttgagacagagtatcactctgtcatccaggctggagtgcagtggcaggatcacagctcattgcagcttcaacctcctgggctcaggtgatcctcccacttcaacctctcaagtagctgggactacaaggcacgtgtcagcaccacacgtggctaagttttaaactttttgtagagatgaggtttcattatgttgcccatgctggtcttgaactcctgggctcaagctgtccacctgcctcagcctcccaaactattgggattacaggcgtggtgggattatgccaccatgcccggcctgatatgggttttttttttaacatataaagaataaagaaaaattttaaatgcacgcaagcagaagttacaatatatctaaaatgaaaaaaaaaatcagatggcagcagatgtcttggtcaaactgaatgccagaagaccatggaacaatgtctaaagaatttagagagaaaatgattgttatccaatagctctacagttagccaaactacttttaaggagctaaaatattcatttcattttatctttttattccttagtgtttcttgcaagtcataatatatttattttattttattgtggtaataacacttatcatgagatctatacccttaacaagttttaagtgtacaatatattattgttgactataggcacaatgatgtaaagcagatctctaaagtttattcattttatttaactgaaactctatgcctattggtcaacaactccccattacctcctccctctagctttgtatatatacttcatgttagtgaaatcctgcagtactagtctgtttgtaactggcttatttcacttagcataagtcctcaaggttagcccatgttgttgcatattgcagaatttcctttttgcataaggttgaatagtgtgtgtatatatatatatataaaacatgttctctatccattcttctgtcattggacatttaagttctttccacatcttagctattataaatgaatagtgctccaatgaatatgtaaatagtagctctttgagatcctaatttcaattttttatatatactcagaaatgtgattgctgggtcacatggtagcactatttttaatttttgagaagcatccatactgttttttatagtggctgtattggtaaaaacaaaacaaaacaaaaataaacaagtgggattacatcaaactaaaaagcttctgcacagtaaaataaacaatcaacagattgaaaaagcagcctatagaatgggagaaaatatctgcaaaccatatatctgaaaaggtgttaatctccaaaatatatatgaaattcatataactcaataacaaaaaatgaattacataatttgaaaaatgagttaagtacttgaatggacatttctcctaagaagacatacaaatggccagtaagtataaaaaaaattgctctatatcactaatcagcaaggaagtgcaatcaagaccacaatgagatatcatctcatacctgtaaggatggctattatcaagaaaatgaaagacaagtaattgagatttatagaagactctgatcaacaacagcagtattaacatttttacaagtgctcaatggaactttcaccaagatgagtcatgaaacatgctggttattttgttgttctcctgtcttaggtccatcagattgtatgccattaatttctccttttactcacacagatacctgtgtgtttctgtggctgttggtgctttgtcttcatctacttggattttaagatctgcgagaataattcatcatgatgttttgttataaacattgttgatggatttttggttttgttatgtagttgctctgcctgtttttatgtagagattaatagagactagccaactatgttcctgccaccaccattttctcgtaatccctatctattacctagatttcagtcttgttaactttaccatatttgctacatctattttaagtatttaaaagcaaataaccatagacattctttcgatttcctctgaaatattttagcatgtatgtcttaaataaaaagacatttttctcaaaaaaaatcatcataccactaccatacctgaaaaactaacaataattctccaatttcatcatctcgcattcagcccatacctagattcctcttttgtcctcacaatagcttttagaagtggaacttttttcaaacagtttccttatgttgcaagggtcctttaagtatctcttaatcaagcctgacattcttgataaaccttttttcttttatttttagattatgatattttctctatggaattaaagagtagtgcattttgttttagagagtagtgcatttttttaagaaaattaatgtccagaaaagataagaccatcaaaaagattaggcctgctgcctgggcaaaaattaggtagagagaccacaggacagcaaccacaggaaccaccctaaccatctcagggaaacaaaacgcctcggggtagtagtgttcaaagttactattagcaccttagagagtcctctctggctcaaaggtaatataatctagttagtgacttcaaaactccaaagcctaagcttgtaactcaggctgtttgtgggttctgtgagcttggcctttggcagatgtagggatgaagatgcctagttcctcccttagaggtaactgtggatcctgcctaagaaataagcattttggtactggtaccaaaacagagatatagaccaatggaacagaacagagtcctcagaaagaacgccacatatctacaactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataagaaccctagaagaaaacctaggcaataccattcaggacataggcatggacaaggacttcatgtctaaaacaccgaaagcaatggcaacaaacgtcaaaattgacaaatgggatctaattcaactaaagagcttctgcacagcaaaagaaaccaccatcagagtgaacaggcaacctacaaaatgggagaaaatttttgcaacctactcatctgacaaaggggtaatatccagaatctacaatgaactcaaacaaatttacaagaaaaaaacaaacaaccccatcaaaaagtgggcaaaggatatggacagacacttctcaaaagaagacatttatgcagtcaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaacactgtggaagacagtgtggcgattcctcagggatctagaactagaaataccatttgacccagccatcccattactgggtatatacccaaaggattagaaatcatgctgctataaagacacatgcacacgtatgtttattgcggcactattcacaatagcaaagacctggaaccaacccaaatgtccaacaatgatagactggattaagaaaatgtggcacatatacaccatggaatactatgcagccagaaaaaacgatgagttcatgtcctttgtagggacatggatgaagctggaaaccatcattctcagcaaactattgcaaggacaaaaaaccaaacaccacatgttctcactcataggtgggaactgaacaatgagaacacatggacacaggaaggggaacatcacacactggggactgttgtggggtggggggaggtgggagggatagcattaggagatatacctaatgctaaatgatgagttaatgggtgcagcacaccaacatggcacatgtatacatatgtaacaaacctgcacgttgtgcacatgtaccctaaaacttatagtataataataataagattaaaaaaaagaattcctttgaaaccccaggagaagtaatattagaaaatgagagtaatattagaaaaagaaagattattagccctttccttacatatcagtgtatagtttcacttgttacagcaagtatgttttacttctaattcaaaggtcatcaaataagataaaatgttctgctggcactttgcaaaagaagggtatcctgatggtcaaagtcatatgaaaagattctcagctctatgagacataaggaaaatgcaaattataaccacaatgtgatatcactgtacatgccaaaatgactaaaataaaaaagagaaaaaagccaggcatggtggctcatgcctgtaatcccagcactttgggaggccgaggcgggcggatcaccaggtcaggagatcgagaccatcctgcctaacacggtgaaactctgtctctaccaaaaatacaaaaaattagctggacatggtggcacatgcctgtagtaccagatactccggtggctgaggcaggagaatcacttgaacccaggaggtggaggttgcagtgagctgagatcacactgcactccagtctgggcaacagaggaagactccatctcaacaaaaaaaaaaaaaaaaaaaagagagagagagagaaatgataacaattttggtgacaacaaatggaaactactggatatgaaataattggtattcttataggctacttgctggagtataaattgatataaccactttagaaaactatttggcagtatctattaaagcagacagatgcatacaccaatactcagcaattctactcctagatatgtacctaacaaatatgtacacatatgaatgttcaataaatgtgtttaagaataaaaaaaaaagaaaaaagcattttaaggcctcagtattttttatagatggaaagtagaattttccttatatttccatgctttaaatttttttttctccaagttattggtagagagtttccatacttaaaaatatcccatcctagaagcaaatcataaggtctgtattccacaggcagaaccctggcttacagaaatacctgggtgcttgacaacaggaggtcattggaggagttggcagcagggtgcaggaatagttgggataattttcctcaagtttgtgtttcccggctttgtgccgatgatcatggagtcagagaggcagcatgagaaatgcttctcagtccaagtaattgaaactaggaaacctgtgagaaaactgagagaagactggagcaaaatcctctaaagggcagtgtgctttccttcactggagggcttgcaaactgccatttgacatgcaggtggcagcattttttttccttttgtctaatgaagccaatcccgtagtcacagattggtcatgttttccccaggatccactaggggattttaatatggtggggctacagaaagatgtccattggtttctaacaacacccacagaaaatttcagaaaccctctctcggttcacaaggccctgtatgatctcctttcactctaccttacatattgctactctcctctagctcactgtatatcctccttgttccctgaaacatgtacttcccacatccctagctcaggggtgcttgcgttagctgttccctccacctggaaaggtcccaacaccctccctccttgaaagccatagagtttgctcatctcccttatttgtggcttaggaaactctttctgtacttaaagaaacaccttccacttctgtctccctatgccttgtgttgtttcatttatttttttaccacatagttaccacctcccaacatgatgtcaaatattgcaatctgtttctctgtttactgtttttattctgtcacccataacagaagcccacaagggttctgcacatgttttgtgacacagcagacgctcaataatgcatgttgaatgaaagcaggatagaccccgtgccagcactcactccatctccacctgctttagagatctggctcaatctctcttttccttacagcagaaaatctggatatgaagattgaggatctgcttaactgagttatagtaacaggttttttcaatgtgagcttagggactaagctggctggcttagctcagagagaaaggcctgggctttgatgacttttcatcttcatctgtggaatctggaggtgcctgttacattttgagagggagtggagagttgagtgctttgctaactcaatagctgcctttcccttctctggcccagcgaaacaaaaagccagtgaagaggtgagagagacttgtgccctctgggagtccaaacagaaggaagtagattcatgtaagtgatgcaagaagaacacagtgaagtcccattatatgtctgaaccctaaatccccctgccctccctaagctctggattccagataattagatttttcaatatggcccccaaagcccacttgggtaccctgccatatatttaacttcaacttctacctctcaccctcctcccactttgatgacaacaaaacactgacagagcacactcccacctcaagggcttttaaaaaaacttttaggttcggttgttacacgtgcaagtttattacataggtaaactcatgtcaaaggggttggttatatgaattatttcatcaaccaggtactaagctcagaaccgaatagttatcttttctgctcctctccctcctcccaccctccactctcaagtagactccagtgtctgttgttcccttctttgcgttcatgagttctcatcacttagctcacacttataagtgagaacgtgtgtatttggttttctgttcctgtgttagtttgctaaaaataatggcctctagctccattcatgtttctgcaaaagacatgatcttgttattttctatggctgcatagtattccatagtgtatatgtaacacattttctttatcctatctgtcactgatgggcatttaggctgattccacatctttgctattgtgaataatgctgcaatgaacatacaccatgtctttatggtagaatgatatatattcctctgggtatatacccaataatggtattgctgggtcgaatgatagttctgttttcagctcattgaggaattgccatactgctttctacgatggttgaaatttacactcccactgatagtgtataagtgttcccttttctccacaaccatggcagcatctgttttttttttattaatagccattctgactggtgtgagatggtatctcattgtggttttgatttgcatttctcgaatgatcagtgatattgagctttttttccatatgtttgtcttcttttggaagtgtctgttcatgtcctttgcccactttttaatgaggttgtctttctcttgtaaatttaagtttcttataggcactggatattagacctttgtcagaagcagtttgcaaaatttttctactattctgtaggttgtctgtttactctgttgataagagattttgcacagcaaaataaactaagattaattagaccccacttatcaatttttgcttttgttgcatttgtttttggtttctcatgaaacttttgcccattcttatgtccggtatggtattgccctggttgccttccagggtttttatagttttggggtttacatttaagtctttaatccatcttgaagtgattgtttaatgtggtgtaaggaaggtgtccagcttcaattttctacatatggctagccagttatcacggcactatttattgaatagtgaaacttttctgcattgcttgtttgtgtcagttttgttgaagatcagatggacgtaggtgtgcagccttatttctgggctctctattctgtttcattggtctatgtgcctgtttttttttttttttttttttttttttcccccaccagcaccatcctgttttggtcactgtagccctgtagtatagtttgtttgttgttttgttttgttttttagagatggagtctggctctgtcacccaggctggagtgcagtggcatgaccttggttcactgcaacttccacctcccaggttcaagcaattctcatgtctcagcctcctcagtagctgggattacaggcaagcactgctgcttccggctaattttgtacttttagtagaaatggggtttcaccatgttggccaggctgttctcgaactcctgacctcaggtgatccgccctcctcagcctcccaaagtgctgggattacaggcatgagccacagtgcctggccccctgtagtatagtttgacgttgggtaacatgatgcctacagctttgttctttttgcttaggattgccttggctattcgggctttgttttggttctatacgaattttaaaacagtttttttctagttctgtgaagaatgtcattggtagtttgataggaattgcatttaatctataaattgctttaggcagtaaggccattttaatgatattgattcttcctacctatgagcatgggatgcttttccatttgtttgtcttctctgatttatttgagaagtgttttgtagttctcactgcagagatctttcacctcccttgttagctatattcctagttattttattctttgtatgacaattgtgaatgtgatggccttccttatttggctctcagcttggttgctgctggtgtatagtaatgctagtgatttttgtacattgattttgtatcctgaaactttgctgaagttgaaggagcttatcagctgaaggagcttttgggctgagactataatgttttctagatatagggtcatgtagcctgcaaacaaggataatttgacttcctctcttcctttttggatgccctttatttctttctcttgcctgatcactctgtctaggacttccaatactatgctgcataggagtggtgagagagtccatccttctcttatgccagttttcaaggggaatgctttcagcatttgcccattcagtatgatattgcctgttgatttgtcttagatggctcttattattttgaggtatgttccttcaatacctagtctattgagagtttttaacatgaagaggtgttgaattttatcaagagccttttctgcacctatttagtaatcatgtggtttttggctttagttttgtttatgtgatgaatcacatgtattgattcgcatatgttggacaaccttgcatcccagggatgaagcctacttgatcgtagtggatgagttttttgatgtgctgctgcattctgtttgcaagtaatttgttgaggattttttcatagatgttagtcaggataatggcctgaagtttttgttgttgttgttgtgtctttgccaggttttgatattcaggatgacgctggcctcatagaatgagttcaggaggagtctctcctcctcaatttttggaagcgtttcagtagaaatggtaccagcttttctttcggcatctgatagaatttggctgtgaatctatcatgtcctgggctttatttgttggtagtctatttattactgattcaatttcagagctcattatttgtctgttcagggaatccatttctttcttgttcagtcttgaaaggaatttatctatctcttctaggttttctagtttgtatgcacagtggtgtttgtagtagtttctgatggctattttaatttctgtggggtcagtagtaatattcccttcatcatttctgattgtgtttattttattcttctctgttttcttctttattggtcttcaaggactttttattatgtttcccctgcctgtagtgctctttgcccatgataatctagatatcttctcattgcctctagtaatctggctctcagctgaaacttcgcttgcttatagagatcttaacttatcttcccaactacaaaatagtacctgcccctccacatctggtcacgtcccattcccttttccttgcttgttatttttttctttatagcccttatcctcacctgacttgatatatttacatctttgttatcatatctctcctacataatttaaggtttgtataaaaccaggtttattctgcaccatattcacactaccatttgtaaatgccagagcctttgagcacttgtagggacatgggcacacaaaagtgaaaggtctggtttcagagtgaccttcactaggtgaagaagatgagataaaaggaagaaatttaggccactcctgggtctgcacaagacctttcatgtgacatcagagaagtcccttccccaaaattggagttgtggaggcaggatagggtgtggtccctaaggtttggaagggtcactggtttttttttttgttccagtgaatgcaaaacagctgagcctagaggtggtcttgaggaaaaagcaaggcatctaatagccatgctctccctttctctgtgcttctgccctaaccatacaatgaaagctaaagattaagaaaatgtggcacatatacaccatgaaatactatgcagccataaaaaaggatgagttcatgccctttgcagggacatggatgaagctggaaactatcattctcagcaaactaacacaggaaaagaaaaccaaacaccgcatgttctcactcataagtgggagttgaacaatgagaacacatggacacagggaggggaacatcacacacccgggcctgttggggtggggggctaggggagggataacattaggagaaatacctaatgtaggtgatgggttgatgggtgcagcaaaccaccaaggcatgtgtatacctatgtgacaaaactgcacgttctgcacatgtaacccagaacttaaagtataataataataaaaaaaaagctaagttctctgtagtagacagatgaatcttgttgaaacgtaaattaagtcacatctcttttacagtaaaaacctctccctacctcccaccttactcatagtaaacacagatgtcctgtcaatgagctgcaaccaggatgtttatctagcccctctccatttatttccttttttaccacttttcttggctgagaccacccagtcatgctgctagtttcctcaatattcccagacatttgctagacacatttcaaagcctttgaatttgccattaactggaacacttcactcactgatagatataattttcataaataacgacatagttacttgtatggtaatgaacttagtatctcccctcaccagtctgttgattccctaatggaaaataacactccccagggtttttttcgattgagtttttaaccaacccaagcccaaagtctgacatgtagtataggaactgaataagtgtttatggaataaatgaactgaatcaatttctagcaaaatgaacaattattattttttaatccctactctctgagaaaaatagcaagacaaaaccagggtaagaaatagagaaaagacatagagatccagccaggccaaaaccaggtaggaacttaagagtagcagtatttagttcaattaactatctctttatccattcaaccctccagtcatcctagcagccatatgttgacccagtattccatcccttcttctctctgcccatccaatccctccagtcttccattcctccactctttgcaactaaccattcatccatacaactatctacccacttatccattcatccaaccaacaattaacccaaccacctatccattcattcatccatgcattcatttcatcatccatcctttgtctacccactatcaatacagtcatctataaaactctttatctgtccatttatccatccaaaaattaatgccatcatccatccataaatgtatggatttatttattcatccatacatcctttgactcattcatttcttcatctatccaactgtatgaccactcatccattcattcaagcatgtgtttatcatctctccatgtagtcatccagccatttactcatccaactatatatccataaatacatctaacatcccttcaccattgatgagagcaaagaaaaatcatccaaagatagagacaaaaaaatgagcaccctagacttttcttagaagaccacctttgttgtatatttgtatgtatgtgttgtgttgtgtgtaaaataaataatcacagaacaaattactcatttctgatagacacttaaagagttcctcttttttgtcagtttgtggaagacagaaacagcagcaggtacagacagattgctctggcacctgcagattctgttcagttcctacaaatatgtggcaattatgccaggccccttgctatgtgccaaggccaacaggatgaatagatgcaggtttgtcttaataggggcccaatctgtgtgataggaactctggaggttggaaatggagacaaagaaccacaatcccaattattcctgtgagctctcacagggcctccttggttcctctccccatagagacacagaggatctttctgatgcaatgcaagggataggaaagtgaggtcagaggtaagaggcccccaccctgccttgcttacttccaaagagaagctgatgataaaccgacaggtaaagtaggaggacttgcggagtcaaatgagccagctgttctatggaaacatccactctgcattcagcgaagagctcttcttccacagcacaatgaagggaagctgaagggaggagttgagggatggaatgatgattccaaaatccttctggctggccctccagaaagtggtttgaggagaacagaaaggtgaaggacgtcctggaggcagcttccaagcaacaccagtaactgcagcataagcagcagaggtgggcaggagccacccccataagaggctgcctatgggggaaacacagaatagttgaacccagctctcacctgggaaagctgtccctgggatcctcagacatacgaattccttttttctctttatccccctctacatgaaatccttcctctgctcttattcctcttccatcacctgctgtttctgctccttctcctctgcttcccaatgttctccttctccacctctaatccttccccatgcttctttccgccttctccttttcttttctccctccactgtccttcaactcttcccttcccttttcctttctttcccttcttcatattcttttccttccctcctctttcttccctcctttcctccttctcctctcttccttttctctcttcttctcatccacttcttctctcttctctctcccttttttccatctcttctttatctaacccttcatctccccactccttctcttcaatcttactttacatccagaattatggcagagataaagaagctggacattgagttcctttcagaaacttataacatcttagaagaagggtccagaaatgaaaaaatagggaggatgaggaaagaagagggaggaagatacaggaaaatggagagaggagcggtttttaaccctaaatggagggattcctgtgaaggaggaggcaaacaagcatggggctgctatacaggagtagaggagcccatgaaaacctttccaaacattttgtctagaagggacatttcctcgggggacatacacagccagtgcacaggcaatgatgtggagccactgaggcagtgaaattgcagtgaggtactggctgacgggtgtgtgtgttagagcagtggtcaccgacctttctggcaccaggaaccagtgaaactgttctacctcagatcattaggcattagttagattctcataacgagcatgcaacttagatacctcgcatgcacagttcacaatagggttcacgctcctttgagaatctactgccaccactgatctgacaggaggcaaagctcaggtggtaatgctggctcacccgctgctcacctcctgctgtgcagccccatttctgacaggccactgactggtactggtctgtggtccgggcattagggacccctgtgttagagtttagggagacccacacaccctagaacccaaggtccctgttccacaaccctctcacctctaggtagaacaccttccacagaccatccaggagtccccttcaggaccctaggagaccaacttagaacacacctcaggaagggccacataccttcctgggaagaaaggaaaatagctttatttaaatgtagtcagaaaatgcatcccagagaaagttaatgaactttaagataagatttaatgtacacttaagatttttttcatgccaatgaagattcatgagtgaataatcttttacttgcatgtttgtacacatgtccatttatgtcctctggaataaattgttgaaggtacatgattgatttggtggtcgtgcatatttaatctttgatacaacttgattttcgtgaagattgaatcactccacagtactaccagcagtttatgagagtgaccctttcaacacatctacactagttaaacatttttgcataggtgccaccatcagcttttgtctacagatgaataaaggctcccagaggtttagcaacaatcactagactactcagctggttaatggcagagccatactttttaccatagaaatgtttgtccccagagccagtgaccttaattgaaattctgagtattatcattccttactaccctgaatacctggatctactctttatttaaatacttcatctctttttccatgatctaccaactaggtttgggattaacagagcaaaaacaaaacaaaactaaaaggttacatagtttttagcctctgtgcaagagtttttctgtactgatggtaatttttcccttgttaaaataacaaaaacaagaaaaccaagccatcttcctgatcaatgagatgggttgtcctttttataatttggcttgatgaatcaggttttatagaagtggttctgctgctgtttttcctgtgatgtggaaaagttcctcagggtccttctgtctagtctggactttttgtcctgctgccacatcactcgatctttgccactgaaccctccactgtccctcatgatattcctcctcagggaactttggttctaggctggggactgcctcagccattagcactcagacttcagtggagggaatcctgctgtcttacctctacctctttactccaggcatggacttggggctttccctaatttcccagtgtattagtccactttgaacacttctgataaagatatacccaagactgggtaatttctaaagaagaagaggtttaatggactcacagttccacatggctggggaggcctcacaatcatggcagaaggcaaaaggcatgtcttacatggtggcaggcaaaagagaaaatgagagccaagtcaaaagggaaaccccttataaaaccatcagatcttgtgagacttactcactgccatgagaacagtataggggaaactgcccccataattcaattatctcccaccaggtccctcccacaacatgtgggaattatgagagctacaattcaagacgagatttgggtggagacacagccaaaccatatcacacagcaaaaaccaagctgtaatatttactgagattttactgaaacttcttaaactgtgggagagaagtgtaacacaaacactaggacttagaaccaagcatagacttcagatgcattctgaaatcccttactatgctaatttcctgcctggctcctggcctgcctccaaatggccagcagcagtttaccacccccaccaccagaattttctataagcatttccagctcagaatcataaccaaacttactaccagcccaaaagagagtgttggaaaacttttcccttatctcagtctaagaaggggggagttctacagtgccttcattttaggcctcaaaacccatcttcatcaagaatattttatagggaaccattcttctttttcagaggaaaccctatccagatacccagatacataggaggtgatctgataagacagttgcgaaatactctgaacgtttatcttcctatgctttggttattactactcttacataacatgaaaaaaagttgtgtcacttttttcttttgggcttctacataaatgccaggtgctaagcatattttctttcattcatcttcagagaaaatcagaaggcacatttgtatttacattttctatgccctttgcactgggtcacagtaacttccccaaaataagaaaagaattggagcatctcccctgtcttagccattggagtgaaagcagtgtcacagtagttacatgtctgggctctggagggagactgcctggataaaaaccctgcttccactacttgtgtgctgagtgactgtcagcatgtcacggaacctctctatcactgtcttaatccataaaattgaatataatacctatacctaaactaataggtaccatgtattgttgattaaaaggaataacgtgattaaaacatttgagaaagtgtttgtatcatggtaaatgttcagtaacattagctatctgtgagtcactgatcagcatgtctcaaatctgtcctatttcagataagtaaggattacagcagcatctccatgtctcttaggatttatatgacaagtggacactagtttatttggtccttacacttgtgatctgaagccacgattatctcataggtaagcttcttatatgaacatgtccaaatgttgaagcctaggagaaatctccagtatgtaaaaggtatccaatgggtgttcatggtggacaggagtacaagattaagatccccagtaaatacatttgtcctctaagtttgaactataaaaccaaggaggatatttgcaaagagtctttaaaacttcagaataaaaaaacttatcatagttacagaaaaaaaaatcagtcagaagataaatatttggccagccatggaaacaatcatagtcaatgcccattccattcccatttgcaaggctttaactattactaaatattggactattttatactgatgccattaaacaggtaaatggcaggcaaatttcatgctggctttccctcattcttgaaatctgtgaactcaccattggactgtttttactctgcattatcttgctggacccagtaatcagccactcattaagcacttgcataatcacactccccacctcacacaatatgcctcctttctcgaagaactttccttgactgagaagtgtctgttcatgtccttcacccacttttggatggggttgtttgtttttttcttgtaaatttgtttgagttcattgtagattctggatattacccctttgtcagatgagtaggctgcaaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcgcatgcctatgtcctgaatggtaatgcctaggttttcttctagggtttttatggttttaggtataacgtttaagtctttaatcaatcttgaactgatttttgtataaggtgtaaggaagggatccagtttcagctttctacatatggctagccagttttcccagcaccatttattaaatagggaatcctttccccattgcttgtttttcagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaacaggaacacttttacactgttggtgggactgtaaactagttcaaccactgtggaagacagtgtggcgattcctcagggatctagaactagaaataccatttgacccagccatcccattactgggtatatacccaaaggattagaaatcatgctgctataaagacacatgcacacgtatgtttattgcggcactattcacaatagcaaagacctggaaccaacccaaatgtccaacaatgatagactggattaagaaaatgtggcacatatacaccatggaatactatgcagccagaaaaaacgatgagttcatgtcctttgtagggacatggatgaagctggaaaccatcattctcagcaaactatcgcaaggacaaaaaaccaaacaccacatgttctcactcataggtgggaactgaacaatgagaacacatggacacaggaaggggaacatcacacactggggactgttgtggggtggggggaggtgggagggatagcattaggagatatacctaatgctaaatgacgagttaatgggtgcagcacaccaacatggcacatgtatacatatgtaacaaacctgcacgttgtgcacatgtaccctaaaacttaaagtataataataaaaaaataaataaataaataaataaaaagaaaaaaaaaaagaactttccttgactgatttatgattggaagtgtagcccagtgctgagcaatgcaccctgaggcgatatttgctgtagttctccttggatctatttctctgctcttaaaaaaaaagaggtaaaagacaaatctttttttaatgagtcaatttaatgttatatagataatatataaacatagacatgcaagcatgtatacataaaattacagaaagacacaaatatgttatagcattgattttaaaattttagctgtgaggctgtgaaactcactagtttaaaaggacagttgaattcaaactgtgcctttgtaaatggaaaagggtaaagtttaccagtcccacatgaccagaggcatgagtttcagagaaaaccgggtagcaaatttatatctcaaagcacacacagagagataattgaagtttttaaaaggagttcctgtgtgttaaagggagaccaaaaatggatgtcaaggtaacacaaaatcttaggaatttaccataggatttttccctacttttattttaggtccagggggtaaatgtgcctgtttgttacatgggtagattgcacgaagagaccaaataattcagcttctgtgtattgccccatctggatctagtactggaagtgctgcagtcatgtcctagtgccatatagcccaacagcacagaagaaaagcatcatggcaagaatcacaactcagcgacattttaatttatgtatgacatatatcaatatctacattgggcatatgaacagttttcacagaactgtaaaacatcagagttgaaatgctcatttgtttttcatactaaaattctgaggcctggtcaactgtgctccataagaattcattgacactgtgttttaaatgttgtgctaggggtttgaagaacacagagatgattcacacaaggtccatgccatgaggagcttaacaatatagaggaatcacataaacataccaattcgatgctgacctacattgcctatcagctgtgtgcctgactacctttgttatttcccaaagacctgagagatatatattacaattcctcttatacagttgaagaaataagctgtgatgagttaagtaatgtaggtagttaaatggaatttggattcacatccagacctgttggactccaaaggtaggtctttttccattccccttggaaatattgcttatgttacagttgttgaaatgtggatgtcatttctgatgacagaaccaccttcccccaacatagaaggatacttgggaaatccaggaattctcaaagtggtactatccctcaaaagactaacttaagagttctgaagatctatactgaaaccaaccagcgtgaagtacaactatctgacatttttatacatcagaaaggattaggtagcttagactgtgacagcagcattagaggccccctctgaagataatggaggatttacataatttgaagagcttgggggctggtattgtcccttctatcattgccctttaaatggagtcaatgacttaagagacagcagttcttttggaacaactgttagctaggaaagggaggtgaaaaccctgccttagagccctgccccactcaacagatgaggagagcttcacttccagagttattctctggggaagcatcaggaaaatacagggaggctcccagcaatctttcctggaagttgtttcctggtccaagtctattaacttattgtgcatattttaataatttatgggcaaagagagccaagggaagggaagtaagttaaattggagaatggtataagagaaagtttggcttaaaacaattgcatgggactacagactgggcaaactagagtggacaacttattactaccactactagttctgtggcctttaataagtaacttatcctctaagacccatatgctcgtatgattgtttctttcactaagatatttgatctttgagagggccttgagtgattggtctttgcatatcaagctttcaggatacttcctgaaatctaatagacatcaatggatgctaaattaaataattaaattttataataacactgattgtaatagccctctttccaattttctaattggagtagtacagtagatcctatctatgtaggtaacaatatatgacatctttgtgtatcaggcactgtacaacatcttgtagacacctgttttgtgttggagggttagagttctcactcatttttcttcatcaacctacacagacaccagcaaaattatctatatacctcatgacttaagcagcatttttttatacttcagtcctttttgtattaactcaagggtttttgtcataggaagacagtcatttcattgtatgcatatttttatgtatataagaggattactttccataaaaataattacaatgaaaacaaaaatagcaaaatttggaaagctgatattaacaagaaatacaggcgatcttacatattattgtgtcttatgtgtgttatttcatcttcacattgtttcctcaatgtatgcattgttattctcttgcatagatatgggagagccataatttgatcctaggacttattttattctaaagctccagagtcctacaatatgggaactccccaacttatactctagcaattcccactctttactcttccttttctctctgttacagcttcttacaattttcatcctaccttttaacaattgcaggccgggtgtggtggctcacgcctgtaatcccagcactttgggaggctgaggcaggcggatcacctgaggtcaggagtttgaggccagcctcaacatggagaaaccccgtctctactaaaaatacaaaattagccgggcgtggtggtgcatgcctgtaatctcagctactcgggaggttgaggcaggagaattgcttgaacctgggaggtggaggttgcactccagcctgggtgacaagagcgaaactctgtctcaaaaaaaaaaaaaaaattgcaggtgctcccaattcctgagacttctctccatatcaagtgaccaaattctgtgcatgcttctctccatattaagtgaccaaattctgtgcaagagtcagtaaaaactgactcttgtttttaccccttgtgtacaattctgtacatggattttctaactgttggaaaaggcagtccactgtaagccccaagtgtctctgcatgtccaaactacaatgctcaactgtccctcaatacagagcagtttctgtagctagtcacataggcaattaaataggcagaggtgaccttagcttaactatttgtgtgactgctcattccctgggaaagggaactaacttgtttgttacaaaaggggcagagcccttgctctttggtttgtcagctgtgccataacacactatgtgtgaagccaccatctgggacttatgggacttgagggaagggaaattagtcctctcatacttatgctcctgctgtctgctgtactgtgagtaataaactgtcttgctctatattgttaagtctcatcatctacttcagaactcatctgcttttggcaaagccaacttgcttacatgcttagttgtcttctttggcattttgttattccctgccattctctatagggttaattttcttcgctgaaactaacccttgtaacaaacaactttggtttttaagtatttttgagatgaagagataactgttatttacaacttcctgccatttaacaagaattgtggttttttgaggaaggtttttggtgcaaagttggtaatttatgggaagaatgtaataaatctgagaaagaagccagattgtcctatttatgaaacaatatgaggattgatggctagtggtgggaggttggagggacaactggagttacagcagatggctggcaggtgatgaaggctttaaacccagacatggggtggtagacacccaaaagaagatatttatgaaagagatttatttgtctattgaagatttttaaaaaatatacttctatggtgtttcccatatctcaagcactgttctatgagctttaactcatttagtcataatcacaatacatgtggtagttcctatcattatattcaatgtatagatgaggaaactgaggcacagagacattagtaaaatgaggaaaacacatttagtaagtggtggggagagaggagagacttggagctgctttgtgggggcatggaatgtcaaggcatggaggattctgataggtagctgttgcttactgagaaacatcagaaaaaaaagagtaatgtttagaggggaatttatggcattttccccttgggatatgctcggaaatgctcttgtttatttccccaaaaaggcctacatgtagatgaaatcttgctttaaaaataataaacaaatatattacaattaaaaaataacagcaacaaaaacgtctgtatgccacaacaattccttaggctccatccatggtttgcataccacattttgggaagcactaactgtgaaaagaccatggtctttgatgttaagcagagctgggctggaatttcaagtctgctacctaacaccatccaattttataattctataaaaatgttcactcaggttaatggtgaagatttagtgaagaaaatgtatataaatcaactagcatattgcccaatatgtattacatatttgacattcttcctgtctttctctccattccagttagaccagtggatgctatccccttattttccatctcattccaacctatcttactttttctcccttcagccatactgaaatagtttgtaggattcctgaatcagccacactctttcatctctgcatctcttcacatgctgttccctcttcccagaatttatttcctctctctgccccttctttacctcaatatttcattcctcttgtagcctgtaatctttgtctccattaaagagttccttaattctctcagtgtagggtgactatcatctgtgctctcatccctatgcttctcagaaatgtttgctttcttaggaagggatccccagcctaattattttacctaccaccaaccctcttcaaactccctttctagacaatacccacaggctagggtattggaagccacagctgagtctgggaagaattcagtggattttgcagattatactatttgctgcagagcattaatattaggagaatctgaggtgcaatgttcaacagcaatactatattggtcccaaatagttctgctaatgatcagtttgaagactcaggacataaaagtgggagaatgtaattgaggacctccagtaggctgaatgattaaccctcaaagatatccatgtcctaatccccaaaatctgtgaacatatttcctgaaatggcagcagggactttacattgtgattaagttaaagatcttgagattgggaggttattctgggttatccaggtagtcccagtgtaatcacaagaggaaggcaaggggattaatatttggagtcagagaagaagaccatggtagcagaagtcaaagaagagataaatttgaagatactactctgttggctttgaatatagaggaagggcctatgagctaaaaataatataggctacctctcaaagatggaaaagtcaagggattacatctttccctagagcctccagaaggaatgcagccttacctacaccttgatttttgcctagtaagaccatctgtgactcctgactttcagaaatataataagtgttttgttttaatccctaaatttgtgattatttgttacagcacaataggaaactaatactgattttagtaacagaagtggggtgttgctgtaataaatacaacaaatgtggaagtggctttcaaattagccaatagatagaggatggaagaattttgagcaccataatagaaaaagcctagattgccataagattttgagttgatgcaattatgggttcagacttttagagaacttggtatggaatgaatatattttacatgtaggacaaatgtgaatctttgtggtaggctgaatgatgtccctcccccaaaagtgcccacatcctaatccctgcaatctgtgaatatgtactttacatggcaaaagagactttggaggtatgactaagttgaggctcttgagatggattatccaggtaggcccaatgtaatcacgtgggttcttgtaagagggaagaagcagggtcagagagggagaccacagaagcagaggtcagagaagaggtagacttgaagatgacatgctgctgcctttacatatagagaatgggccatgagccaaagaatgcaggatgactctagaaaatgaaaaagggagtgagttctcccctagaacctccataaagaacacatctttgctgatgcattaatttttgtccagtaagatcacttctgactcatgacctccagaaatgtaaagttacagtagcaataagaaagtaattcagaaacaattgggggtagaatgcagggtctaagagttggaggtggagtctgaaatgggtctctgaaatactgtaggtagtgaagaagctatatcagttcatctcctagaacatggacaattgcctaagttcatctagagtctcttgaatgggggggtaggggcacacatacagacacacagaacatatgacaactatgggaaaaaccataatgtaactattgtccctataagaagaatatatattccaaatccaaatataagttccagcactacacatagggaagactgcattatataggtatctatggaactcctgtctatgaaagaggagtggcttaatagaacttaatttaaaaaaattaaatatgtgacagattaatgatggagttgaaccatgagactacatctggtggcattgaggagttagttgtgggcaagggtggctagaaccgtgcctgtatgaaggaataccttcatggtaggagcaagaatgtgtagcacggtacccatatgtggaagatggctgagtaaaaggtgcccagcactctcatcctccataaaggaccaaaacagctagtagataatcacgtgtcaaataggacatctaagagagaacactgtaattaagcagggaagtgacaggaactttccaaggcatggaaggagaaagaagtgaagcagccagccaagagaggattggctcagagacaggagagattccccattgcaaagaaaaggtaagtgagagatccccagtatttattttcctactgtagacatcagcaattttagccacagaagagtccctctgccctcacaggccctgagcatagtagagggagctgcttggagtccatgttccagagtgcattgttccagaaagggaaatcacactgggtcttatacatcccctgagacccaagcaactgcagcaaagtgcaattttgagagcccagcccccaccagactaatcaatggattgccttgcctgctgtcacttctgcatcctccatgagccaaacaggggtttgaagacaggcccaccctgcttgccaccaccgttgcctgtgcacctaacaccgttgctgctgctggtatgtacatgggactcctaggagtccatgaacaagcccacccagattactgtcacgaccaccacccacatgcaccattcaggaaactggggaccagctcacgtggcccaccacagctaccactggtgcctgtatgcattgacttggggcccaaggactggcctactcacactactatcacaggtggcaccacacatgtggcccagaaaccagaagacccacctgcttgacctgcaactgctattgtcagtgcccaagcatagagcttgatctgggggccagcccacctgggcttcccacaaccactactagtgcccgcatgcactgattagggccctgactactagcacacccagcccaccaccaccaccacttatgcttgaggaccagcccagtggtgttaacatacacagaaaagccttactacatcctccactaacaactgcagcctaagccattaatgaatccacagacaccactgatattgattacagctgaagaatcacatggatactacagtactgtgtgtaccaagaatcaaattcaaatcactgtaccaaatcaacactatagatatatgtaaagaaaatattttccctaaaaaagccaattcataaagttgaataaagtgactcttacaccagacatgcagctattaatgtaaggatgcaagaaacataaaattcaatgaaatatgacatctccaaaggaacacaataattctccagtatcaggtccaaagaaaaggaatctataaaatgcctgaaagcgaaatcaaaataaatgatcttaaacttagtcagatgcaagagaacacaaataatacaaagaaatcaggaaagcaattcatgatttcaatgagaaatcaacaaagagatggatatcataaaaaataccaaacagaaatcttggaactgaagaatttaatgaaacaaattaaaaatataatcaagtgcttcaacaatagaccacatcaggcagaagactttctgaacatgaaaacttatcttttgaaatatccacatctgaccaaaaaagcaaagaagaataaaaaaggatgaagaaagcctatgggacttttatgggacaccataagagaaataaatattcaaatttttagagttccagaaggagaagggataagaaaaggcatagaaaaccaatttaataaaataataactgaaaatatcccccaaatcttacaagagatatagacatccagatatgggaaattcaaagatcctaaatagattcaacccaaaaagttcttcaagacacattagagtcatcaacccaataagatcttcaaggcacagcacagtcaaactgtcaaaggttaaaaacaaagagagaattcgaaaaacagcaagagaaaagtgtcaagtcatagataagggaatcctcatcaggctaacagaagatacctaagttgaaacctcacaggacaggagagagtgggttgatatattcaaagtgctgaagaaaactaacaaacaaacaacaacaacaacaaaaaactcggccaagaaatgaggaggaaataaagtgtttcccagacaagaaaaaaccaagggaattcatcaccagcagactgaacctataaaaaaatgcttaaaggagtcctacatctggaagcgaaaaaatgatctccaccatcatgaaaacatacaaaagtatacaactcagtggtacagcagatacataaaggagacagagaaaggaattaaacattatcaccacaaaaaaaaaaaaaaaacccaccaacctgggtgcagtggctcatgcctgtattcccagcattttgaaaggcagaggcaggaggattgctttagcccaggagtttgagaccagtctgggcaacatagtgagacctaatctctaccaaaaataaataaataaataaaattaaaaaattagccaagcatggttgtgcatgcctgtagtcttagctacttgggaggctgaggtaggaagattacttgagcccgagaagatgaggctgcagtgaacaatgatcacatcactgcactccagcctgggtgataaagtgagatcctatctgaataaaaaagaagaacaaagaaacaaatgacacacaaaataatcataaaataattcaaaaaatgactggagcatttgaatgcaaatggcttaaattccccacctaaaagacatagagtaattgaatggaaaaaaaaaccaacacaagtcccaactacatgctgtctacaagtaactcacttcacctgtaaaggcacacacaaactgaaagtgaataaatgacaaaaatacaccacatgaatgaaaaccaaaacttgcataagtagctatagttatataagacaaaatacatactaagtcaaaaaaaaaaaaaaaaagagagagagacaaggaaggtcattacataatgaaaaagggaatgattcaacaagaggatataacaattctaaatatatgtgcacccaacaccggagcacccagatatataaagcaaatattaatagagctaaagagacagagagactccaatacaataatagttggagatttcaacacctgaatttcagcattggagagatcatttaggcagaaaatcaacacagaaacattggacttaatctgcaccatataccaaatgaacatctacaaaacatttcatccaaaagatgcagaatacacattcttctcataagcatatggaacactctgggatagatcatatgttaggacacaaaacaagtctcaacaaatttttaaaatttgaaattatatcaagtgtcttcttggaccataatgaaataaaactagaaatcagtaataagaggaactttggaaactggagaaatatatgaaaattaaacatgctccagaatgacctgggtcaattaagaaattaagaaggaaatcaagaaactttttaaaaaaacaaattaaaatagaaacaaaacataccaaaacctatggcatacagaaaaatcagtgctaagagggatgtttatagcaataaatgcctacatcaaaaatagaatgatttcaaataaacaacctaataagatatctcaagaaaccaaaaaagcaagaacaaaccagtctaaaaattagtaggatgcaaaaaaataaggatcagagcagaactaaacaaaatagtaactaaagaaaaactataaaagatcagcaaagtgaaaagttggctttttggaaagataaaattgataaagtgtgagtgacacaaaccaaggaaaagagagaagacccaaataaataaaatacaaaataaaaacaagaaattacagttgataccacagacattcaaaggataattagactattatgaacaactatatgctaaaaatattggaaaacctgaaggaaatgaataaattcctggacacatataaactaccaagattgaaccagaaagagacagaaaacctgaacagggcaataatgagtaacacaatgaaatcagtaataagagactgccaatatagaaaagtccaggaccgaatgacttcactgctaaattctaccaaacttttaaagagaaaataacaccaattcttctcaaactcttccgaaaatttaaagaggaggaaattcttcctaacgcactctgtgaggccagcattaccataataccaaactacacaaggacacaacaaaaaaagaaaactataggtcagtgttcatgatgaacatatatacaaaaattctcaacacaatactagcaaaacaaaatgataacattatgataaagtgggatttattccaagaatgcaaggatgactcaatgtactcaaatcaataaacatgatacatcatatcaacagaacaaaggacgaaactcaaatgatagtctcaatagatgcaagtaaaagcatatgataaaatccaacattgcatcataataaaaactctcaataggcatagaagaaacacttcagcataataaagaccaatatgacaaacccacaagtaacatcacacttatggggaaaagcttgcagaattaagaactagaacaagacaatgatgaacatgttcaccactcttattcaacatagtactggaagtcctagaaattaggcaggaggatgaaataaaaggcatccaagttggaaatgcagaagtcccatggtccctggttacagatgatatgatcttatatatagggaaacctagagatttcaccaaaacgttcttggaaatgataaatgaattcagtaaaattgcaggatacaaaaccaatatacaaaaatcagtagtgttttttatttatttttttaagagaccgagtctcacttatgttgcccatgctgatcttgaactcctgggctcaagtgatccgccttggcctcccaaagtgctagaactataggcataagccaccatgcccagccctagtagcatttctacacaccaataacaaactgattgaaaaagaaatcaagaaaccaatttgattacaataggtacaaaaaaagtacctaggaagaaaactaatcaaggaagtcaaagagctctacaatgaaaactacaaaacatgagacaaattaaagaggacacaaacaaatggaaggacattccatgctcatgaatcacaataattaatatagttaaaatgaccacactgcccaaagaaatctacacactcagtgcaatctttatcaaaataccaatgacattcctcacagaaataaaaaaaatcataaaattgatatggaaccacaaaataacctaaatagccaaaacaatctgaaatgaaaagaacaaatctggaggcatcacactacctgaattcaaaacatactacaaagctatagttaccaaaacagcatggtattggtataaaaacagacacatagagcagtggaacagaatagagaaaccagaaatgatgctgggtgtagtggctcatgcctataatctcagcactttgggaggctgagccaggtggatcacctaaggtcaggaatttgagaaaccagaaatgaatttatgtatttacagataactgacttttgatgaaagtgtcaagaacacacattggggaaagggcatactcctcaataaatggaagaatgaaactaggcttctttcttgcaccatgtacaaatatcaactcaacttgaattaaaacttaagtgcaatactcaaaactataaaactactaggagaaaacatgtgggaaacacttaaagacattggttaggtaaaaattttatggctaagacttaaaaagcacagtctactaaaataaaaatagacaaatggggttatattaaatgaaaaaaaaagcttctgcacaggaaagggaaaaaaataaacacagtgaggagacaagttatgcaatgggagaaagtatttacaaatgattcctctgataagggactaatagtcaagatatagaaggaactctaaaaactaaacagcaaacaaacaaataatccacttaaaaagtgggcaaagaaactggacagccatttctcaaaagaccagaaatggctaataaatatgtgaaaaatgctccacatcaggaaaatgcaaatcacaaccataatgagatatcatctcaccccagttagaagggctatatcaaaatgacaaaaaataaatgctggcaagaatgcagagaaaagggacttattatacactgttggtgggaacgtaaattagtacaaccattatggaaaacggtgtaggattttctcaaaaaaaaaaaatagaactaccacatgatcaagtaatcccactactgggtgtttatcaaacaaaaaaaaaggaaattagtatattacagggatatctgcaccaccatgtttattgcagctatattcataatagccaagctatggaatcatattaagtgtccatcaacagataaatgaatacataaaatattgtatatatacacaatggaatattattgatacagtttggatgtttgtctgctccaaatctcatattgaaatgtgatcctcaaagtggaggtggggcctagtgaaaggtgtttgggtcctggaagtggatccctcattaatgtcttggtgccatccgtatggtactgagtgagttctcactctattatttcatgcaagagctagttgtttaaaagaacatggcacccctccatctctatcttgctccttctctcgctgtgtaacatgccggctccccttcccttcctgaggcctcacaacaagccttaggaatacctaagcctggccaatttaaaatgtaaaaagagatttatttgactcatgattctgcaggctgtacaagcatggcaccagcatctgctcaacgtctggagaagcctcaggaagcttttactcatggtggaaggtgaagaggagctagtataccacatggtgagagaggaagcaagagagatgtcaggttattttaatcaatcagatctcatgattactaatatagtgagaactcactaccacagggaaggcaccaagcctccctatgacccaaactcctcccactgggccccacctccaccattggagatcacattttaacatgagaattggaagaaacaaacatgcaaactacatcagtggtcgtgaatttctttttgattgggatctgtttttgaagaatcattgtgttcctctggagatgccatatttccttgcattttgtgtttcatgtgtccttatgttgatatctgcacatatggtgtaacagtcactttttcccattttatgaatttgctttcatagggagaacattttcttaaatatgtatttgtgatgtcagttaggtagggcacattggctttgattctgagtgcatgcagtagtgtagtctctgtatgatttcttcagctgtcaacagcattaatggtatctgtgattttttttttggtggcttagggtgaagttattagtggaggctctgggactgggatgccatgtaggtcagtcttcaggccatagtggtggtagcagtgagctgagcatgcctgtctttgggccccagggcagtgtaccctggcagtggtgtcagtgggtccaggcagggccattcttgggcttccaggtggcttacttggatcgagatagtgccagttgtaggcagggtgagttggtgggttcttgagtccctgggcagctggtatggtataggtgatggcagtgacagtggcaagacaaccctctatgagctagtttgtgcatgttggtgttggttgtgtttgtgattggctggatgggcaagtcttcagacccacaggtggcataagcaggtatgtgtcagcttagttgtagtagctcagtggataggcccaactgggaagtgttcaggtgctgatgatggtggatggggctgggtaatcccctggccctggactgtgtgctctgggttgtgagggcttgtcctctttgctaagtacaggtgccagccatagtagataggggctgggctatacctaggccaccagcagaatgctgagggggtagcagtggccaggctggggtagggccaccagcaggtagggaatgtgcatgactgtcatgcctcagcacctgctatggcatctgtaccactcatgcctcagctccagtagcagcaacctgctcttctcttgcatctcatccccaacactattggacctcagtatggtgtgcagtctgttggggacaggaatctaaaaatggcacttttctgtagctgtttaggtctcaggaagtgtgtgggatccagcgggtgctccctccatagagcagtgccattacacaatctcctggcaactccttatgttagtttcagggcctgcaagaatctagtggctctttcgtggctaggattacagaagttcatggtggaaatccatttacgttcaaaattgttattgataggtgaggactggggattttctcttggctcccagcttatcccagccaagcaggctgccttgcttccttctccttccttattttagatatttcctgttacttttttttattgaattacagtgttctccttttgatgatctatttgaagtgtgattatctagtgttatggtttggctttgtccccagcaaaatctcaccttgaattgtaataatccccacgtgtgaaggacagggccaggtggagataatataatcatgggtgggggcgcagtttcccccatactgttctcctggtagtgaataagtctcatgagttctgatagttttataaatgggagtatccctgcacatgctctcttgcctaccaccatgtaagacatggctttgcttcttattcgcctacagccatgatcgtgaggcctccctagccatgtggaactgtgagtctattaaacttctttcctttataaattacccagtctcaagtatgtctgtattagcagtgtgagaacacactaatattgttttgatacttcttagtggagcaggtgagtacaaaatgcctctagtcagctatcttgaagtccctcttatctcaaaaattactttaaaaataaatgaattatccaatcaaaagacacaggttggctgaacaaatacaaaacacgagatccggcaatatgctgcccacgagagactcactttagcctttaggatacacatagtccaaaagttaaagtatggaaaaagatatttcatataaatggtaaccaaaagaaagcagggatgattatcttataagagataaaatagacattcagtcaaaatctgtcataagagagaaaaaggtcagcatataaagtggccaatgaattaaaagaatataatgattgtaaatatacatgcacccaatattggagctcctaaatatacaggcaaatattgacagaactaaagggagaagtagatagcagtaaaatagtagtagggtactttaatacccattatcaacaatggatagactatcggtacagaaaagccaataaggaaacagtgtatttgaatgatgatacagaccaaatggactgagcagacataaatagacattccatcaaacaacagaggaatatacattcttctgaagtgcacatggtcagttcttcaggatagaccatatggtcatccataaaacaagtcttaacaaatttgagaagatttaaatcctctcaaataccttttctgaccacagctataaaaccagagatcagtaacagaagtaattttggaaattcacaaatacatggaaattaaacaaaatactctggaacaaccaatgggccaaagaagaaatcaaaaaggatttttgaacaaagaaaatttattgcaacatagtaacatgtatgggacatatcaaaagcagttctaagagggaatgcctaaattaagaagaatatttcaaataaaaaaaaacctaaccatatacctcaaggaactataaaaagaagaacaaactgagaccaaactcaagagaaggaaggaaataaagattagagcaaagataaatgaaaaagagactagaaacccaacagaaaagataaacaagactgagctgggttttttgaaaagataaacaaacttgacaaaacttttagctagacttgaggaaaaaagagggaggactcaaatcaagttataaatgaaagagaagacatatataactaataccacagcaatacaaaggatcacaaggtaatactgtaaaaaaatatatgctaacaaattggtaaacctagaagaaatgaataaattcctagaaacatacaatcaaccaagactgaatcatgaagaaaacaaagatttaagagaccaataatgagtaaagatatttgaccaataattgaaaatcttccaacaaagaaaagcccagtatcagatggctttaaaggtgacttctaccaagcatctaaagaagaattaatggccaatctttttcaaactcatcgaaaaaattgaagagggggaaacacttccactcattttacaaggccaacattactccataccaaaggcagataggagattataggaaaattataggataatatccctgatcaatatatgtgtaaaagttctcagcaaaataccagcaaagtgaattcaacagcacatttaaaggattacacatcatgaccaagcaggatttatgcctgggatgcaagcgtgtttcaacttatgcaaatcagtaaatgggatacactacattaacagaatgaaggataaaaattatataatcatgagtagatgcaggaaaagcatctgacgagattcaacatcttttcataataaaaattcccaacaaattaggtataaatggaaatttactcaacataataaagaccatctatgacaagctcacagctaacataaactaccatcagagaatattacaaacacctctacacaaataaactagaaaatctagaagaaatggataaattcctcgacacatacaccctcccaagactaaaccaggaagaagttgaatttctgaatagaccaataacaggctcttaaattgtggcaataatcaatagcttaccaaccaaaaagagtccaggaccagatggattcacagccgaattgtaccagaggtacaaggaggaactggtaccattccttctgaaactattccaatcaatagaaaaagagggaatcctccctaactcattttatgaggctagcatcatcctgataccaaagccgggcagagacaccaccaaaaaagagaattttagaccaatagcctcaatgaacattgatgcaaaaatcctcaatataatactggcaaactgaatccagcagcacatcaaaaagcttatccacaatgatcaagtgggcttcatccctgggatgcaaggctggttcaatatacacaaaacaataaatgtaatccagcatataaacagaaccaaagacaaaaaccacatgattatctcaatagatgcagaaaaggcctttgacaaaattcaacaactcttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtgcctttttgcagatgacatgattgtatatctagaaaaccccatagtctcagcccaaaatctccttaagctgataagcaacttcagcaaagtctcaggatacaaaatcaatatacaaaaatcacaagcattcttatacaccaataacagacaaacagagagccaaatcatgagggaactcccattcacaattgcttaaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcgggaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaaaccaaaagaacaaagctggaggcatcatgctacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcaataccattcaggacataggcatgggcaaggacttcatgtctaaaacaccaaaagcaatggcaacaaaagacaaaattgacaaatgggatctaattaaactcaagagcttctgtacagcaaaagaaactaccatcagagtgaacaggcaacctacaaaatgggagaaaatttttgcaacctactcatctgacaaaggggtaatatccagaatctacaatgaactcaaacaaatttacaagaaaaaaaacaaacaaccccatcaaaaaatggacaaaggacatgaacagacacttctcaaaagaagacatttatgcagccaaaacacacacgaaaaaatgctcatcatcactggccatcagagaaatgcaaatcaaaacaacaatgagataccatctcacaccagttagaatggcaatcattaaaaagtcagaaaacaacaggtgctggagaggatgtggagaaataggaacgcttttacactgttggtgggactgtaaactagttcaacctttgtggaagtcagtgtggcgattcctcagggatctagaactagaaataccatttgaccaagccatcccattgctgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaacaatgagctcatgtcctttgtagggacatggatgaaattggaaatcatcattctcagtaaactctcttaagaacaaaaaaccaaacaccgcatattctcacttataggtgggaattgaacaatgagatcacatggacacaggaaggggaatatcacactctggggactgttgtggtgtggggggaggggggagggatagcattgggagatatacctaatgctagatgacgagttagtgggtgaagcgcaccagcatggcacatgtatacatatgtaactaacctgcagaatgtgcacatgcaccctaaaacttaaagtataataataaaagaaaaaaaaagctgaaagctctttctctaagatcaggaagaagaaaagggtccccacttttctcacttctattcaacatagtactggaagtcctaaccagagaaattaggcaggaaaaggaaatataagggatctaaatcatgaaggaaacagtaaaataatctctatttatacctttaaatatttcaccaaaaaatctgttagaactaataaattcagtaaagtttcaggatacaatgtaaacatacaaaaattagtagcattttaaaaaataaacatctgaaaaggaaatttaaaaaacaatatcatttacaaaagcatcaaaaagaataaaatacttagcgaataatttaatcaaggaggtgaaatatctatacactgaaaagtgtgacattgatgaaagaaattgaagaatacacagttaataaaaagatatcccatgttcctggattgaagaaattaatattgttaaaatgtccatagcaaccaaagcgatctacaaattcaatgcaatccctatcaaaactccaatggcattttcacaacagtataaaaatatcctaaaatttgtatgaagtcattgaaccacaaaatacctcaaatagccaaagcaatcttgagaaagaagaacaaagctgggcatattacatgccctaatttcaaactgtgttacagagctatagtaatcaaaacagtatagtactggcataaaaacatatatagagactaatgaaacaggatttagatcccagaaataaactcgcaggtatatggtcaactaatctctggcaagagcaccaagaatacacaatggggaaaggatattcttttcaaaatgtgattttagagaaattacatatctatatgcaaaagaatgaaattggatccttgtcctacaccataaacaaaaattaactcaaaattgattaaagacttaaatgtaatatttgaagccataaaactcctagaaaaaaaatgtagggaaaaaacttctttacattggtgttgacaattatttttggatatgataccaaagcacaggcaatgaaagaaaaaataaataaattagactacattaaatgaaaagcttctgcacagaaaaggaaacaatcaacaaaatggaaaggcaacctatgaattgggagaaaatatttataatctatatattagataaggggttaatctccaaaatacataagaaactcatacaactcaatagcaaaacaattcccaaataaccatattttaaaatgggcaaaaattccagatagctatttttttcaaagaagacatacaaatgcccaacgggtacaggaaaaggttctcaaaatcactgctcaccagggaagtacaaatgcaaactgcaattggagatcacctcacacttgttagaactggctattaaaaaaaatacaagagacaagaagtattaacatggatgtggagaatagggaacccttgtacattgtcagtgggaatgtaagttgatacagtcattgtggaaaacagtaaggagcttcctcaaaaaattaaaaataaaaccatataatctagcaatcccagttctaagtatatatcccaagggaataaaatcactatcacaaagatatatatgcacttgtgttcactgcagcattattcacagttaccaagatatggaaacaaccaaaccgtccaccaacagatgaatgaataaaggaattgtagtatatatgtatatataagggaatattatccagccttaaaaaaaagaaaatcctgccatttatgacattatgaatgaacctggagaaccttttcctaaatgaaataagccagacacagagagataaacactgcatggtctaacttgtatgtggaatctaaaaagtcagaccaatagaatctgaggtagaagggtggttagtacaggtaaggatgtgtgggaaatagggagatgttggccaaagggcacaaaattgcaattataaagtggctaagttctggagacctaatgtacagcatggtgactatatttaataataaggtattgtatatttgaaatttgctaaaacagtagatctcaagtttcctcaccctcccccgacccccaacacacacaaaatggtaactgcttaaggtgatggatgttagcttgattctgttaatcatttcacaatgtatacttatatcaaaacatcacattatacacctcatatatacacaatttttatttttcaataatacttcaataaaactggaaaaaaattagtaagaattaacagctcagaaacactgagtcttctcattcatgaacaccacggctctccaccatttatttacatctttaatatctctctacaatcttttataggtttcagtgtataggtcttgcacatcttttgtcagattcaactgaaattattttatatttttgatgctattatacatttttaacattcgattttcagtttaccattatctagaattgtacttcatttttatattgatcttatatcctatagccttgctaaactcacttattattcatagcagtgtttgcacagattctatcagtttcttttattgcttctgatcttataggaaaagcattcagtctttcatcattacaaatgatcttagctgtgcgtttttcacagacgatctttttcagtttggagaagtttcgttttatcactagtttgctgagagtttttaatatgatggataatggattttgtcaaatgctttttctgaatctattgagatgattatatggttttccttttgtagtttgttagtattgtgaattacattgattttcttattgtcaaactgtgtttgcatttccaggataaactccacatagacatgatatattatccattttatatataattgtatttgttttctcaaaagtttggttagaacatttgcaccaatatccatgaaagatactggtttgtagttttgttttgtctttgtactgtctttgctttgttttggtataagagtatgctgatctcatagacatagttgagaagtattcgctcctcaattttccggagtaatttgtatatacttggcattatttctttgtaaaatgtttttcaaatttcaccagttaagtcacctgggcttagagttttcttttattattattattattattatactttaagttttagggtacatgtgcacattgtgcaggttagttacgtatgtatacatgtgccatgctggtgtgctgcacccactaactcgtcatttagcattaggtatatctcccaatgctatccctcccgcctccctccaccccacaacagtccccagagtgtgatgttccccttcctgtgtccatgtgttctcattgttcaattcccacctatgagtgagaatatgtggtgtttggttttttgttcttgagagagtttactgagaatgatgatttccaatttcatccatgtccctacaaaggacatgaactcatcatttttttgtggctgcatagtattccatggtgtatatgtgccacattttcttaatccagtctatcattgttggatatttgggttggttccaagtctttgctattgtgaatagtgccgcaatgaacatacgtgtgcatgtgtctttatagcagcatgatttatagtcctttgggtatataccgagtaatgggatggctgggtcaattggtatttctagttctagatccctgaggaatccccacactgacttccagaagggttgaactagtttacagtcccaccaacagtgtaaaagtgttcctatttctccacatcctctccagcacctgttgtttcttgactttttaatgattgccattctaactggtgtgagatggtatctcattgtggttttgatttgcatttctctgatggccagtgatcatgagcattttttcatgtgttttttggctgctataagaaggtttttattttcaaatagaatttgttaaacaaatataatcctaatcaggcgatctacttactcttgagtgtgttttggtagtctgtatctttcaagtaacatgtacattttatgtgagttgccatatatattaacacaaagttgtttataatattgccttatttttcttttaatatctgtaagatgatatctgtgatgtcatctctcttagtcccggtattggtaatttgtgtcttctctgtcctattttcctgatctgtctggtgagaaaatttatcaatattgccaatcttctcaaacaaccagcatttggtttcactgatcctatctttagcattttctgttttctatttcattgatttctgctatctttattatttcttattttgaattttatttgcttttatttttcttgcttcttaaggtagaagttaaagtaattggttttagtcctttttcttttaaaatataggcagctagttatatatatatatatatatatatatatatatatatatatatatatttttgtttgtttgtttgtttgtttgtttgtttgtttttgagatggagtctctctctgtcaccaggctggagtgcagtggcacgatctgggctcaatgcaacctctgcctcccaggttcaagcgattctcctgcctcagcctcctgagtagctgggattacaggcgagcaccaccatgcccagctagtttttgtattttttagtagagacgggttttcaccatgttggccaggatggtctcaatctcttgacctcgtgatccgcctgcctcggcctcccaaagtgctgggattacaggcgtgagccaacatgcccagcctgatatgatatatttttaagtactgatttagcagcatcttaaaaattttgtgctttttatttactttaaaatactccttaatttcctgtttattttttctttgatctgtagtttttcagatgctgttacatagtttctaacattttgagattttccagataaattctgttatttatttccagtttaattttattagggtaagaaaacatatttttgtatgacttaaatctattttaaaattaatgatacttgtttaaggcccagaatgtattcaatcacggtaaatgttccataagtatttcatgagaatgtatgcgaatgtacgctttactactattaggcgcagtgctttatgctatgtcaagtttgttaagttgtctaagtcttcaacttctaaatccttaccaatgttttgtctacttgttaatgagagaaaagtattgaaatatcttactatatctgtggatttgtttttccttcatgtattttgaacctctgttcttctagtaaggatttttagcatttctaagtgcttgtgatgaattatttcacattttatgtgacttaaaagtcattaatttgcctccatttatggaatatgttttagatgaatatagaattttaaattgattcattttctttcaatactaaataattattgctttactgtcttcttgcttgcctttttcctgaagcaaaatctgtcattctaatttttgttcctatacacataataatttttgccctctggctactttcaaggttttctctttggcattggctttaagaatttaattgtgctactgtctggtatagttttcttcacatttcatgttcttgggatttgctgggctttttggatgtgcaggtttgtatttttcataatatatagaaaaatttaagccattatctcttcaagtagtttactctgtaccatccctctactttcttgtggggaacttcaattttatatacatttggcttcttagttcttttttctgcgtttcattttcaatgctttatagttgcacgacttcaggttcagtaatttttctccacaatgtctaatttgtcattaatttctcccagtgtattttttatctctgacattgtgatttacatctccataagtttgtgttttttatatatttcacatttctaattaactttttgaacctttagaatacatttataataattttaaatgtctcttttgataattctaacatctgtgtcaggtgtatgttgattttaattaataattaattatgttataactaattaagttatcacttcctacttctttgtatgcctagtaaactttgattgaatgccaggcattgtaaattttaccttattgggtaccagatgctaatatttttatgcattttcttcagtttcattctggaatgaagttaaaatgcttggaaatctttttatccttttgggtctttgagttttttaaggagagatcagacctgcgtttagtgcagaactaattattctccactactattgctagtcttttctgaatattttatccattgctttgtgaaatattaggttttgctatgttagtggtacaaagaggcacaattcatggtcatgtgtgagagtcaggcagtgttccctctaatctctgatgattctttccttagccctggttattttccacacacacgtgacaataagtactgctgcatactaaaaggagactcctcacagatctccagagttctttctctgtgcagcagtctcttctctggtactctgttctgtgaacttttgctaattttgtcttccatatcagtcctatctcctcaagtgagggcatctgctgtactccacctgagttttccctccctgccatggcctggaaaagctctaaaagccatacgttgggccaatagtagagttcacctcatttgttttctattcctcagagttcactttcatttgttgcctgatcttgtttatcatatttttatttgtgtacctgtgtttccttgtatccttataataaaatatcagctccatgaagttcaggcctttggttcagtgttgagtacaatagcagctaccatctttctactatgttctagcacttatgctcactatcaccctgggaggtaagttttattagttttatttgcacttgagcaagcatgcgctgaatgctagacagacttgccctccagtgatacaaagcatgtaagaagtgacaaagtttttgtttgacctgaagtcacttagggaagccaagtgggattttgttttgccatatatagtatcgttaggcagattcatatcaacatgactgaaggctcactaaggacagtcaccacaattttgctccatttttacctctgactcctagtccagtgatcagaaaccaataagaaatcaagaattactcgatacatctttctttttggggggagtaggtccatttttaataaaattgtatttatatgaaatgatatgacactcttttattgggttgagaattatccagtagggaagaaagttaggatctagaagtctaatagttggaacaagagccaccaggagtcgatgatgtatgttataacttggtagttggtacaagggattttcttgtattattctatctaattatttgtatttttgacatatgccattgaaataaataaaactgatgttatgtaatgggattcattctataatgatattcttcagtaactctcccacacatcattttggatttatttttctctaagtgtcaaaacaaaagtttaattaattcaacaattaaagataggtggatttgctgtcattttgtgagtgaagaatttatctatgttgcaataaagtcatttcaattaccaaagttatctgcctgccacattttttggaagcacttattttgaaggaaaaggctttgaaattttaggacttttgtttgaatcacacatgtgcacctattgctatgtgactttctacattctaaaaatcataactcacacattcttgagaaaattaaaggagataaagcattaaagcaccaagcatagtactaaaatatcaaaaggactcaattagtattatgatggcgttgtttttagagccaaaattcaaatgtagccattgtcatgactggacacaactctagtgtttagaaagccatttcacatatacacatctaactcagcatattatctccacttcattagtggaaaagtatgtttcagacagttctgatagcaaggatattaggtagaacagagtgcaaggtgaaaaagaacacaagtgtctggtttctagtccactgtacttttcttctttggtcaggaaatatctgccattttatcccctttgcccccaggcctgttatggtacccaatgacaaaagctaataccttaggaatcatccagactaatacctctttcttccacttcctaatttatgcttcaatttctttattccagcctattttatttccatatttcctaccacagcccacaccacctcattatccattgtctttctagacatactctgttcattttatgcatgccatgtaccaggcactgtactcagagctggggacacaatggtgaaggaaacatattccttgacctttggcaggtctgggactaatgggtgattcagacaaagaactgcttgtttacaacacaggaagactagggttgtggtagaggaagtacagagtgccatgagagctttgaatctcatgtaattaataatcctatctgggtctgtttccttgagcaggaatacaggggttgtcccttcctatatgtgtgtcttttgcaacaagagaacccttcccagaaatgctctgttcccaaattccatttacagataatattttattttctgagcctgaatgaaatcttggttatatttgggacattaaaacagagccttcaccacatgcaatccagtgacattccaagtaaaaaaaaaaaaattgtgcattttcattcagctttacttgtggtagatgaaaagaaaattgatgttgacaaagtttttccatctgctattactgctattaccttcatcctaacagctgagttgtgcaactgtgatggtgtctctctttacaccaatatataagaggctctatggaaactggactgagtgaaacagacatagacccagccatcatggggcttacaagatattataacaaactgtgatgagtgctttctgatatggggagtacaggatgctatgaccattagtgcaggaatctattcgagtttatgagaatttatgccttttctgtgttttccatattggaaacacaaccaagattttgaactcatttattaggtgttttatgctaataaaaattataatattagggtgtaaatcattgaatacattattcacagatatgctgtggcaagtggcactagcagtggagaaatggatattttaggaagtggaatattcatagacagttttattgaatctgttggaaaatccaaatggtatggcttaggcttcttcagaatttctagaagaattcctgcagttagctggcagcagatttctgtctcaaaagtgtccagaacgtgagcctcttgcatcaggaatatagctcatttaggatgctgtcctttgcaataagagttccatttagcactttcaggcgaaatagtatcaagtaccaaaaaagaggctgcctctgcttgtgagcctctttataaatatgaacgaaaattttctttttttttgataaagcaaaaagcaatatggacattgtttatttcacagtaaaatacagtataactggcaaagtgttgaagctgataactattcatcgttaggtaactgatttatacattacagaccaacacaagtttctgctctcctgtcattaattacattttactataattatatcatgatgcatataaacttagaaattatcatactacaaaaatgatttaacagcacattttatgcatcttaataagcacagactcagactcttaatcttttcaaaaacaaggatgttaaattctatccttgttctgaacttcataatgcttttcatagaagactaccatctctttgtctccaacattccacatgcctcaaaaatctatttatggaatggaaggtggacatttaggggtactgtagaacacaaaatgtgcttcaattcttcttaatcctaaataagccttattttcccagtctgtctttttttttcaaattcattgtttttttttaaatttaattttattattattatactttaagttttagggtacatgtacacaatgtgcaggttagttacatatgtatatacgtatatgtgccatgctggtgtgctgcacccattaactcatcatttagcattaggtatacctcctaaagctatccctcccccctccccccaccccccaccccaaaacagtccccagagtgtgatgttccccttcctgtgtccatgtgttctcattgttcaattcccacccatgagtgagaatacgtggtatttggttttttgttcttgggagagtttactgagaatgatgatttccaatttcatccatgtccctacaaaggacatgaactcatcattttttatggctgcatagtattccacggtgtatatgtgccacattttcttaatccagtctatcattgtgggaaatttgggttggttccaggtctttgctattgtgaatagtgccacagtaaacatacgtgtgcatgtgtctttatagcggcatgatttatagtcctttgggtatatacccagtaatgggatggctgggtcaaatggtatttctacttctagatccctgaggaatccccacactgacttccagaagggttgaactagtttagagtcccaccaacagtgtaaaagtgttcctatttctccacatcctctccagcatctgttgtttcctgactttttaatgattgccattctaactggtgtgagatggtatctcattgtggttttgatgtgcatttctctgatggccagtgatggtgagcattttttcatgtgttttttggctgcataaatgtcttcttttgagaagtgtctgttcatgtccttcacccactttttgatggggttgtttgttttttaattgtaaatttgtttgagttcattgtagattctggatattagccctttgtcagatgagtaggttgcaaaaattttctcccattttgtaggttgcctgttcactctgatggtagtttcttttgctgtgcagaagttcttgagtttatttagatcccatttgtcaattttgtcttttgttgccattgcttttggtgttttagacatgaagtccttgcccatgcctatgtcctgaatggtattgcctaggttttcttctagggttcttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaaggcattggtagcttgatggggatggcatggaatctataagttaccttgggcagtatggccattttcacgatattgattcttcctacccatgagcatggaatgttcttccatttgtttgtatcctctttaatttcattgagcagtggtttgtagttctccttgaagaggtccttcacatcccttgtaagttggattcccaggtattttattctcttttaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagcggtgagagagggcatccctgtcttgtgccagttttcaaaggacgttttctaaaaactcattaaccccaaattccatttttcagttaccatttctgagcctgtataatactttggtcaacttgggatgttagaaattatcctccatcacgtttcacctaggaaaaacatccgattccaaaaatgtcactgaaattggcagagtaaagacctctgaaaaaatttatcctttataaaagcaatgagaacaccaacaaaaagtatcataattagcattttcagaatgttggaataaaccaaaagcttgcagcaatctggagagtatttattcaggaaaaataacagaatctcaataatagtacattttatggtgttttaatatgccctattcccaatatttccacattatataattttaaaggtgcagttttgaacaaaaaattataagacatgcaaagaaacataaaagtctcagccatacacaggaaaaaaggcagccaatagtgactatccctgaaacccagatgttggtctcattagacagagactccaaataagctattataaatatattcaaataagtaaaggaaaccatgtctgtaaaaaccaaaggaaagtataggaatgatttattaccaaataatcattatcaataaagatatggaaattatattttaaaataacaaatataaattctgaagttgaaaattacagtaactaaaatttaaaaatttactagagaaggtgatttctgcatttccatctgaggtactgggttcatctcactagggagtgccagacagtgggcgcaggtcagtgggtgcagcgcactgtgcgtgagccaaagcagggcaaggcattgcctcactcgggaagcgcaaggggtcagggagttccctttcctagtcaaagaacggggtgacagatggcacctggaaaatcgggtcactcccaccccaatactgcgcttttccgacgggcttaaaaaacggcgcaccaggagattatatcctgcaactggctcagagggtcctatgcccacggagtctcgctgattgctagcacagcagtctgagatcaaactgcaaggtgacagcgaggctgggggaggggcgctttggtaaacaaagcagctggaaagctctaacggggtggagcccaccacagctcaaggaggcctgcctgcctccgtaggctccacctctgggggcagggcacagacaaacaaaaagacagcagtaacctctgcagacttaaatgtccctgtctgacagctttgaagggagcagtggttctcccagcgcacagctggagatctgagaacaggcagactgcctcctcgagtgggttcctgacccctgacccctgagcagcctaactgggaggcaccccccagtaggggcagactgacacctcatactgccgggtactcctctgagacaaaaattccagaggaacgatcagacagcagcattcgtggttcacgaaaaaccactgttctgcagccactgaagctggtatccaggcaaccagggtctggagtggacctgtggacctctagcaaactccaacagacctgcagctgagggtcctgtctgttagaaggaaaactaacaaacagaaggacagccacaccaaaaacccatctgtacatcactatcatcaaagaccaaaagtagataaaaccacaaagatggggaaaaaacagagcagaaaaattggaaactctaaaaagcagagcacgtctcctcctccaaaggatcgcagttcctcaccagcaatggaacaaagctggacggagaatgactttgacaagttgagagaagaaggcttcagatgatcaaactacgagctacaggaggaaattcaaaccaaaggcaaagaagttaaaaactttgaaaaaaacttagacgaatgtataactagaataaccaacacagagaagtgcttaaaggatctgacggagctgaaagccaaggcacgagaactaagtgaagaatgcagaagcctcaggagccgatgtgataaactggaagaaagggtatcagtgatggaagttgaaatgaatgaaatgaagcaagaagggaagtttagagaaaaaaagataaaaagaaatgaacaaagcctccaagaaatatgggagattgtgaaaagaccaaatctatgtctgattggtgtacctgaaagtcatggggagaatagaaccaagttggaaaacactctgcaggatattatccaggagaacttccccaatctagcaaggcaggccaacgttcagattcaggaaatacagagaacaccacaaagatactcctcgagaagagcaactccaagacacataattgtcagattcaccgaagtggaaatgaaggaaaaaatgttaagggcagccagagagaaaggtcgggttacccacaaagggaagcccatcagactaacagtggatctctcagcagaaactctacaagccagaagagagtgggggccaatattcaacattcttaaagaaaagaattttcaacccagaatttcatatccagccaaagtaagcttcataagtgaaggagaaataaaatcctttacagacaagcaaatgctgagagattttgtcaccaccaggcctgccctaaaagagctcctgaaggaagcactaaacatggaaaggaacaaccggtaccagccactgcaaaatcatgccaaaatgtaaaggccatcgagactaggaagaaactgcatcaactaacgagcaaaataaccagctaacttcataatgacaggttcaaattcacacataacaatattaactttaaatgtaaatggactaaatgctccaattaaaagacacagactggcaaattggataaagagtcaagacccatcagtgtgttgtattcaggaaaccgatctcacatgcagagacacacacaggctcaaaataaaaggatggaggaagatctaccaagcaaatggaaaacaaaaaaaggcaggggttgcaatcctagtctctgataaaacagactttcaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagttaacaaggatacccaggaattgaactcagctgtgcaccaagcggacctaatagacatctacagaactctccaccccaaatcaacagaatatacatttttttcagcaccacaccacatctattccaaaattacttccacatagttggaagtaaagctctcctcagcaaatgtaaaagaacagaaattataactaactatctctcagaccacggtgcaatcaaactagaactcaggattaagaaactcactcaaaactgctcaactacgtggaaactgaacaatctgctcctgaatgactactgggtacataacgaaatgaaggcagaaataaagatgttctttgaaaccaatgagaacacagacacaacataccagaatctctgggatacattcaaagcagtgtgtagagggaaattcatagcagtaaatgcccacaagagaaagcaggaaagatccaagattcacaccctaacatcacaattaaaagaactagaaaagcaagagcaaacacattcaaaagctagcagaaggcaagaaataactaaaatcagagcagaactgaaggaaatacagacacaaaaaacccttcaaaaaatttatgaatccaggagctggttttttgaaaggatcaacaaaattcatagaccgctagcaagactaataaagaaaaaaagagataagaatcaaatagatgcaataaaaaatgataaaggggatatcaccaccaatcccacagaaatacaaactaccatcagagaatactataaacacctctatgcaaataaactagaaaatctagaggaaatggataaattccttgacacatacactctcccaagactaaaccaggaagaagttgaatctctgaatagaccactaacaggagctgaaattgtggcaataatgaatagcttaccaaccaaaaagagtccaggaccagatggattcacagccaaattctaccagaggtacaaggaggaactggtaccattccttctgaaactattccaatcaatagaaaaagagggaatcctccctaactcattttatgaggccagcatcattctgataccaaagccgggcagagacacaactaaaaaagagaattttagaccaatatccttgatgaacactgatgcaaaaatcttcaataaaatactggcaaaccaaatccagcagcacatcaaaaagcttatccaccatgatcaaatgggcttcatccctgggatgcaaggctggttcaatatacacaaatcaataaatgtaatccagcatataaacagaaccaaagacaaaaaccacatgattatctcaatagatgcagaaaaggcctttgacaaaattcaacaactcttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaatcaaatacctaggaatccaacttacaagggacgtgaaggacctcttcaaggagaactacaaaccactgctcaatgaaattaaagaggatacaaacaaatggaagaacattccatgctcatgggtaggaagaatcaatatcgtgaaaatggccatactgcccaaggtaacttatagattcaatgccatccccatcaagctaccaatgcctttcttcacagaattggaaaaaactactttaaagttcatatggaaccaaaaaagagcccgcatagccaagtcaatcctaagccaaaagaacaaagctggaggcatcatgctacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaatgttagacctaaaaccataaaaaccctagaagaaaacctaggcattaccattcaggacataggcacgggcaagggcttcatgtctaaaacaccaaaagcaatggcaacaaaagacaaaattgacaaatgggatctaattaaactaaagaacttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaacctcatcaaaaagtgggtgaaggacatgaacagacactcctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacagatgctggagaggatgtggagaaacaggaacacttttacactgttggtgggactctaaactagttcaaccatgtggaagtcagtgtggcgattcctcagggatctagaacttgaaatgccatttgacccagccatcccattactgggtatatacccaaaggattataaatcatgctgctataaagacacatgcacaagtatgtttattgcggcactattcacaatagcaaagacttggaaccaacccaaatgtccaacaatgatagactggattaagaaaatgtggcacatatacaccatggaatactatgcagccacaaaaaatgataagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctgggtactgttgtggggtggggggaggggggagggataccattgggagatatacctaatgctagatgatgagttagtgggtgcagcgcaccagcatgtcacatgtatacatatgtaactaacctgcacattgtgcacatgtaccctaaaacttaaagtataataataataaaaaaaatttactagagaagtacaacagcagatttgggcaggcagaagaatcagcaaacttgaaattatccagtccaagaaccagaaagaaaaaaaaccagaatgagaaaaaaatgaccagaaccgtctacactatccagcacatcaacataagcttaatggaaaaatcatagcagagaaacacagggacagaaacaacatttgaagaaaaaattgccaaaacttcccaaatttgatgaaagaaatcaacctacacatctatgaagctcaaaaacctccaagtaggatcaatcaaaggtatcagttagtcacatcataatgaaactgttgaaagtcaaagacaaaaacagactcttgaaagcagcaggagagtagcaacgcatcatgtacaaggaatcctcaataaaaatactagctgatttcttaccacaaaccatggagaatagacttttaatatatcataacatatgtcacttttaatgacatattaaaagttctgaaagaaaaataatatcaaataagaatcctatagccagcaaaactatccttgaaaaataaaggagaaattaagacactctcatataaagaaaaatgggaagaaatgttgctagcaaacttaacctacaagaataataaaagaaatatatgtagtataatgtaaaacacagtataaatatatttttattataattctcttttctcctatctaatttgaaagacaactgcacagagcaataattataaatctgtgttgatccgcatacagtttgttaagatgtaatttgaatgataataacagaccaaaggagggtgaagagaatggagcaatatagaaacaatgtccttgtaaaccattgtaattttattgatattaacaaactacaatgccataaatttttaatttgttaattttaattaccagagcaattactaagaaattaagttttaaaatatagtaaaacaaatgacaagtgaatttaaatggtaagttagaaaataacactaaagaaggcagtaatggagcaataaagggaaataaaaacataagatattaaaaaatggcaaaagaagcagacataaattttaccttatcggaaattacatgcaatataaatgaattaagcactccagtttacaggcagagctggcagaatgacttaaaaaatattttccaattacattccatctacaagagacacactttattctgccaaattcatatcaaatttcagctgggattttgcagagactgacaaggtgattctaaaatccctacggatatttaagggaccttgaataccaaaaaggatcttaaacctaaagaacaaacttgatattaaaggtattaaagaaagcctaaagaggtttgtctcttcaagttcttcaaagacaaaaagaagtggatactataaggatagaaaaagatataccattccaatagtagccaaagggaactggagtgcctatgctaataaaagataaaaccgactttaaaacaaaaatgttactaacagcaatgaaaaacattttataaagataaaattatcaatttatcaagaacctataacaattataagcatataagcatcatatagcagagccccggaatacatgaagaaaaactgacagaatttaagagataaatagacagtttaaaaataatagtgaatacttcaatactctactttcaataatgaatagaacaactagatggaagatcaacaaggaaatagaagatatgaataacactaaaaaacaaactagatgtaacagacatctaggaaatactctactcaaaaacagaagaatacacattgttctcaagtgcacagggaacattctccaggatagatcatatgttagacaacaaaacaagtcccaataatataaaaaatactgcactcatataaagtatgttctctggtcacctgtgaaaaacccacagaaaacaacatgtttttgcaaaaagactgaaaatcttcccctaagatgaggaacgtgacaaggatgtctgcctttgtgacccctattctgttatactggaggttctaactggagaaattaggcatgggagaaaaaggtatctacatatataaattatataattataattatacatgtatgcagatgacatgacattttatagaaataatactaaaaaattcacacaaaaactattagagccaataaaagagttcagcaagattgcaggacaggaggtcaatacacacacaaaaaatggttgtttttccatccagtaggaatgaaaagtttgaaaataataataaaagacaattccatatataatagactcacaaagaataaaatacttaagaataaatgtagcatgggaagtgtaaggtttacacactgaaaaccacaaaacttaattgaaagatattaaataaaacctaaataaatgaaatgacgttccatgtttgtggattttgagacagtatttttagatgccaatactccccaaatttatctacagatttgacacaatacataccaaattccagctgagattttgcagagactgagaagctgattctgaagtccctatggaattgaatatccaagtacttggtattcaatattaatgaaacttgaatacccaaaaggatcttaaatatgaagaacaaacttgaaggacacacacttctcaatttcaaatcttaccccaaaggtactgtaatcaagactatgaagttctggactacagatatacatatagatcagtggaataaaattaaagtccaacaagaaaccctcacatttctggtcaattgatttttgacaagggtgctaatgttaatgttgtcttttcaacaaatacttctggaacacccacatgcaaaggaataaaattagacttctactccacactatattttaaaaactcaaatggatcaaagacttaaatataagaggtaaaactgtaaaactcttagaagaaaacaggttgaaatcttcatgaccttgaattaaaccataatttcttagatatgacaccaaaagcacaagtaacaaaagaaaaagataattaaattgaaagtcatcaaaattgaaaatgttttggctttaaaggacactattaagaaagtgaaaagataacttacaaaatatgaaaatatttgcaagttatatatccaataatgatctagtatccagaataaagatcccttacaactaaataataaaaatacaaataacccaattaaaaatgggcaaaacatctgaataggcaggtttccaacaaagttatacaaatgtcaaataagcacatggagagatgctatttttaataattatgcaaatgaaaatcaaaataacaaaaagtactatttcacatccagtaagagggctataatttaaaagtcagacagtaacaaacgttggtaaggaggtcaagaaattagaaccctcatacattcctggtgggaatgaaaactgctgcaggcacttcggaaaaacagcttagctgttcctcaaaagttaaacatagagttgccatatgacccagcaattccactcctagatttatactcaagaaaactgaaggcgtatgtccacatgaaaacttgtacatgaatgtttatagcagccttattcatgatagtcaactggtgaaacaacctaaatgtccattagctgatgaaaggataaacaaaatgtgttatctctgtactcttgtggatgctctgaagcaccagatggatcttcactcaaaatttggtttagatgttgtgagtggtgacaccacacatgcatcaggagaatatagaatgatttattattcacataatttaactttcttggggaaagcagagtgactatcaagaaggtttgaaaatgacatgagagagcagggataaaagactggcttggggtttctatgctggttagagggtagggactgggtgaggattccagggcatggtttgaacttcttgccatcaccaaagagaagaaggcacagactcttgtcagcaagcccagatgtgtgtggagcaggaggggaaaaagaagtgtggttaaagctgtcggcagtcaaacatccaaaaatggagtcagaattaaaaagtaaacttaataggtagtagttattaagagccagtaattaagctattctccttcagctccaaatctacccttctgttctctgctttgagatgctgggcctcagattcagaaaaccgtttttctgttgatgccaatggttccttgttaagctttgtcaatagggagtgttggagagagactggaagctgaaggaagacaggacctgctccttcttgactgcttcctgttgctgtcagtaaaacccagagttgtcaggccactcatttcggggacagcaactgatttcagtttgcagtttttctaacactcattgaatcagcttattgcaccatcagagacactagcaccagccagtcagtacccccttctcagaggtctcagttgcaaatctgtggggctcctcctgtaagcctctaagttttatttattctaacctccccattttgttcttccagtcccagaggtaatagcagattcttgtaattgttacctccatgatactttagtattctctttatgcattcttaattcatccatatcaatttaacaattctttatattaaatgctctctttttacaaaaatgacgtcagacttttattaaattttattttgtttccccttctaacttgacttgtgactgaaatgtgccattttgtattgaattgaacttgaatttaaataagccattatgacactctatgaggactgcagtctgaggctggtaagggaggtgaacatttcattgaattccatgctcaacaggccagcactgtgtgttttgaaaagtaattttaatgccttggttactaccagtgatttctgtacctctgaaggggataataagtgtcttggtgaaactttgcattgtggctttcttgtggacagaaatatatgtaacaattatttgtattttgggtatcttgagataaacaattattgggaattgctgttgctgtcattagccagaccagctgtcgagactactggcaatgactcaagcatctgtagaaatgtacagatagggttcagccaattttgttgaccactaggtctcatcttttatcaggggtgccacagtaaagggataaaaagcagcaacactccactgacctccgtcacttgcaatggtgttaatgcaatccataaaatgtatgaaatcttcttgctatatgctcggttaatggcaaccaggtatccaaatgggccagaaaaagggtgacctcctcaagcaccatggcatctggcaaaggactaaggacagggaaggctatcactgcctgcaggtaggacatgccagagatttcaggtttgactccattctgtaataaggaaatcttggtggaataatgagttttcaggatattgctttcacaatccaacaaataataggcagctaagtacaggaagtcactggttcagcacccgagagagcctctattttcaggagacacttgtatgctgccagcaactgccactctgggatatagcatggggcttaggagggtagtttcttgcgttagtcacccatgggcaacttatggccatcatgggtggtcctgagactccaagacacatgagaggaggttgcttaaagtctctacagtgaaggagttcctggggggcactaacaacagtgcctatagtattgtgatttttgcagattctagagccttttgttatagggcgctctgatggttaattttatgtggcagtttgactaggctatagtgctcagttatttggtcaaacactagtctagaagctgctgtgaatttatttgtagatgtaattagcatttacaatcagctgactttatgtgaaccagattatccttcataatgtgaatgggcttcatccaatcagtagaagcccttaagagcaacacctgagggtttccaaaaaataagcagttctacctcaaaattgcaacatgaaaacttgcctgagtttccagcccgctgccctgccctgcagatttggggtttgccagcctcgtattcatgtgagccaatttcttaaaacagatttacctctctcttcctcattctcacactgtgtgtatatgtatatgtgtgtgtgtatgtgtatgaagatgcatgtatatatatgcatatatgtatatttgtgtatgtatacgtaaacatgtatatatatgtgtgtatatacatctatttttctattttgtatttatagctataaaattttattttaattataattatatattttctatttcatgttacacacacacacacacacacacacacacacacacacgcaaattgttttcgatggcaaagctgtttggatatcccatggatagggtaggatatccattgtgtgtttttggaggtgaaggcaaatgggctgagacgctgttgaaataggcactgaacagaacatattagtcaaatctacaacaacaaaatattaaccagttgctgattggatggagtcaataatcttaaacatattagttacgggggccttaatcagtgggactacagcattaaagagtgatgataattcagggtgaagtgccattcattctttccaagtttaataacaggccagatcggattgttaagtgaagaaacagtggagataatcacctattctataaataggtcttgcagttgtttatgcagcaatagataaccaggacgatgcagaagtaaaacaaattagtgtgtagacttaaccatataccaaaacataatatatttatgaatgtgttagtagaattacaagatgtttatcaatcgtaaacttaactttcacttaaaattaagtcttggctacagttttttctcattaaatgtacagctacctcatttaaaaaaatagatcttgtacaacaggtctcaatccttgaaggccctattttaacatacattgggatgaattgactagagggaaggttcatgggaaccaatattttaagctgaattgtaagtgccaaagacttgacttaattttaatttattactctttaggtcagagcatccatgcccactgtgaagtattttaggtaatgggtgctattacacatggtgtattagggtactctagagagacaaaactaatatatatatattatataggtaatgggtgctattacacatggtgtattagggtactctagagagacaaattacccattacctaaaatacttcatagtgggcatgggcgctctgacctaaaacatatatatcttatatataggatatatattattaatatatattaattaatataattaataatacatattaataatatatatcctattagttctgttcctctagaacccatatataaatatatataaataaatatatatataaaatatatataaataaatatatatataaaatatatataaataaatatatatataaaatatatataaataaatatatatataaaatatatataaatatatatataaaatatatataaatatatatataaaatatatataaatatatatataaaatatatataaatatatatataaaatatatataaataaatatatataaaatatatataaataaatactatatataaaatatatatataaaggggagtttattaagtagaaatcacatgatcacaaggtcccacaataggtggtctgcaagctgaggagcaaggaagccagtctgaatcccaaagctgaataacttagagtctgatgtttgagggcaggaagcatccagcacaggagaaagatgtaggctgggaggctaagccagtctagtcttttcacatttttctgcctgctttatattttagtcaagctggcagctgattagatggtgcccacccagattaagggtgggtttgcctttcccagtccactgactcaaatgttaatctcctttggcaacaccctcacagacacacccaggatcaatactttgcatccttcaatccagtcaagttgtcactcagtattaaccattacatatgggtaattaagcaaggtaacagttacaatgggtaagatgaggcattgctatctgtcttttattttatgttcagtcacttccctaaggctatgagatataccttgtttaaatttcgagagatccccaagcatagtagcagccatttgggccacagtattgatgacacaaagatttgctaattggtgcaaataagcagttgttaaatttattcagaacctatgttgtaaagtgtataagtcaaatcagcccccttttatctttttgttttataaattaggtaaatgtattcccaattgtgtcaaattatggccatttcaggtttttttttcttttgcctccccctatgtccagttttcttttacttttctctttctctctctctctctctcttccctgcccccgaccccccgccccccgtgggtgattatcggatatcctttggaagaaggagagttctctctaccctatttatctttatgaattacttcctctagagaacctcaaatcagtattattagggttagcctcccccacagcaatggtggttttatagggtttaaggaccctggacttcagtcagatttgaattaaccccttggtatgccatacagttgccatgggtgtttctccctataaccctcaagatcagtatcattcttatgacagaggcataggcagtagaagcaaaggcattttgaaggatcctagtgagccacctgcttttaggagtgtggacctccacatgtcacatatgactggtttttcccctctattggctgctttttcactttctaatgatttctcattcataagccatcattcaatagctcaatatatcacagaggatataagtctttcccctgagcactctatacaatggggggtaatgctggttgagacatacaattaatctgtcacagggcccaggtggttccctcagcctagagtcattaagagcttatgctgaaattaaaacacgttattcattctaagacacagttaacctgagccaaggcacatgacacagggccacattaaggaagataccagtcccatactcctgtgaattatctaaactcagacttaggtatattaaatctataaaggaggcttcagtacaactcagcaaatgtagcacaaagaagctcagctcaaagattgtgctagcctgcaagtagtggctcttaagtgcctgctggttttcaggcagaagacccagttagcaagtcaaagaaagacaataaagatccccaagatggtggtcataatctagacatcctccttactgcatcacttgtggacccttgcagaggtagatagatcttcacccaaaatttggtctgcagaaactacataccaaccaagaggatatttcataccaacagggtatgaaaaagtttactatgcatatgaggcttgcttgagacagcagtgtggctcccaagcaggtctgaaaatggcttgagaatgcagggaaggaaactggtgtttagaggatagggtcaaggtgagggttcctatgtatagtttgaacttccctccagtatcacagaagggagcacccaggctttcctatcaactttcccagatttgaggcagaagggaaaagaggagggtttatgctttaaagctgaaacatcaaaaatgggcagtctttattaccatacaatggaacatgattgtgccataaaaaggaatgaagtactccccttaatgcatgctacactatagatggcccttttaaacaatatgctaaataaaagaagtcaaactcaaagggacatataatgtacaattccatttatataaaatgtctagaataagcaaattcatagaggcagaaagtagaacaatagttgtcaaggtctggggattggaatggggagtgactcctaacgggcatagagtatctttccagggtgataaaaatgttttggaattaaacaatggtgatgtttgaacaacattgtgaaaatactgaaatgcactgaattgtaccctttagcagagtcaatattttggtgtgtgaattatatctcaataaaacaatcatattagatttctatacaactataggttaaatttgcataaaaacatagcaaaagaagttgaatttttgtatacagtaatcttcttgagagcaaggactctaatttatttctgaaaccagagtgtatgacacatagtgggcatttgatatattctttgaatgtgtgagtgaggcataaactcattaatttagccagtctttattgaaaacacagtatattctaccactatgataaaacattgttagcttacaaattcaatctcatttaaaaataagagaaataaaaaataagcatttcctgcccatggcaataaattcagaacataataaaatatattaggaagagaaaaaacctaaagtgccactgatcagagatgaccactgccaacattttgtagcgtacccttcatacttttctctatgtatgacacacatatatataaacacaatcataaatatcttttttaaatgtgtagaaatgccatatactttgtaaactgttattttagcttgataataggaagtacatataattttacttcaaataatatacctacatcatcatcattaaaacttttcattgaaaaacggcatctatgtttaaaagtgtataaatcataagaatgaagttaaataaactctcataaattgaacaaacctgtataatcattgcccatatcaagaaacagtactttaccatcactcctgaaccacctcctcatgccccttaccagttactattccctcaagagtagtcactatcctgactttcaaaactacaaattacatttgttttaaaaagttaaataggagccggggcaggatggcccggcatctgctccatggagctcacagcccagcctaggctggcaactccagtctgccccagtttccagttctgtccattccccttgcagctcagcatggatgaagctttgaaatccagctctccctctccctctcccgtctccccacggtctcccccgtctccccacagtctccctctccctctcccgtctccccacggtctccctctccctctgtttccacggtctccctctcatgccgagccgaagctggactgtactgctgccatctcggctcactgcaacctccctgcctgattctcctgcctcagcctgcctagtgcctgcgattgcaggcacgcgctgacacgcctgactggttttcgtattttttttggtggagacggggtttcgctgtgttggcctggccggtctccagctcctgaccgcgagtgatccgccagccttggcctcccgaggtgctgggattgcagacggagtctccttcactcagtgctcaatggtgccctggctggagtgcagtggcatgatctcggctcgctacaacctccacctcccagccgccttccttggcctcccaaagtgccgagattgcatcctctgcccggccgccaccctgtctggaaagtgaggagcgtctctgcctggccgcccatcgtctgggatgtgaggagcccctctgactggctgcccagtctgggaagtgaggagcgtctccgtccggccgccatcccatctaggaagtgaggagcgcctcttcccggccgccatcccatctaggaagtgaagagtcgggccgcccatcgtctgagatgtggggagtgcctctgccctgccgccccgtctgggatgtgaggagcgcctctgcccggccgcgaccccgtctgggaggtgaggagcgtctctgcctggccaccccgtctgagaagtgaggagaccctctgcctggcaaccgccccgtctgagaagtgaggagcccctctgcccagcagccgccccgtctgagaagtgaggagcctctccgcccgacagccaccccgtctgggaagtgaggagcgtctccgcccggcagccaccccgtccgggagggaggtgggggggtcagcccccgcccagccagccgccccatccgggagggaggtgggggggtcacccccctgcccggccagccgccccgtctgggagggaggtgggggggtcagccccccgcccggccagccaccccgtccgggaggtgaggggcgcctctgcccagcagcccctactgggaagtgaggagcccctctgcccggccagccgccccgtccgggagggaggtaggggggtcagccccccgcccggccagccaccccgtctgggaggtgtgcccaacagctcattgagaacgggccaggatgacaatcgcggctttgtggaatagaaaggggggaaaggtggggaaaagattgagaaatcggatggttgccgtgtctgtgtagaaagaagtagacatgggagacttttcattttgttctatactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcgtcaccactccctaatctcaagtacccagggacacaaacactgcggaaggccgcagggtcctctgcctaggaaaaccagagacctttgttcacttgtttatctgctcaccttccctccactattgtcctatgaccctgccaaatccccctctgtgagaaacacccaagaatgatcaataaaaagtaaataaataaataaataaataaataaaaaagttaaatacactgaatttggctaagacagaggaacccctttctcttataactaaaagaccctggacataacaaaaaaaaacaagtctggaagactcagaatagtggaaagatgataaacagcacagggagtttagaactcaaagaacaacacagaaatgaattccctgggtttccttatttccttacatatgtccagtacagagtgctgcagaagcctgcaacctagaactgccaacagatacaaataaagctccaagaaaagactgttttccctaggcaaaggaccagaaacgatggcctaataatatcaaactttctggcaattcccactctactccaggtaaacgccaatggaaaaaccataccccaccaaaccaccacctctgcctgtggtttcagtgagactgagaaataagttgatcttctatttcatcccacctccatccccacagaatcagatgtcagtgttctaattccccactcagctgtgttaacagggccaaaaaggggcttatcttttattatctgcccagtggaagcagttagtgatgatctgatttccctacttggacagtgttagtgcgacacagtgaaaaccttattttgtatgtcccgctgggaagaagcagatgatgctcctatcttcctgcccatgtagtgtagtgaggtagagtgggtagctgatcttctgttccctatccggtagaaaaaaagtggtactctaattctcctgtcagggaggagtcagcagggtccagtagcaagctgaacctccaccttcacccaacagcaatgtgacttaacaaggtagtgaaaagtggagctagtcatcgctaggtttcacaatttctcccttacagtgtcagtgggtagaaattcctcagcagacagaggagtttctacccctacgtgcatcaatgagacttaataagacagtacaagtcagagctggtaagcattccctttcactccatccctgatatcagtgaggcccaggaagtaggtgaatcaccaaactcacaactcatttgtaccctcatttagtctcataatgagactcataatgagactcattatgagactaaattaggtggcacaaatcacagctagttgtcacctctgtccaccctcccacgtatagaaggtcatccagtgacagaagatagcacaggtgtgtgcctcctactcatgcagaagtcaccagcatggattggttaggagccttggcagcagcagaagccggaatcacaccagaatatcatttcgaggactcataaaacttttcattacaatgaaagcccggaaaagtaggccagaacttacatgctaaaccaaaacaaggtgactccattacaatagaagatttaggtaagatcattagtcccctaacatagtaataaaaatgtccatgattcaatttttaaaaatcacttgtcacattaagaaccagtaaattcacaatatgaatgagaaaagacaataaacagaagccaataccaacataaatcataagttggaattatctgaaaaagattttaaggcagacattgtatagattctcttttaaaatgaaaaaaaaaaatcccagcaaatgaaagtcataaaaaagaaccagaagaaattgtagaattgaaaattataacaattgaagctaaagaaaaactttctagatggacttaatagtaaagtagagatgagagcaaatagaatcaataaacttgaggacaaatcaatagaatttactcaatttgaacaatgaaaataaaatggactgagaaaaatgaagagtttcatgggcctgtgggacaataacacaagagagaacttttgtatcatacaagttctggaaagagagtagagagattgtgggagggaatattaaagaaagtaatgaatgaaaacatctcaaattttgtgaaagatacaaacctatgaattcaagaaactgagtgaacaaccaatagataaatgaaaggaaatctatgccagagaacattataattaaacttctgaaatttaaacacaaagaaaaaaatcttcaaagctgccagagagaaaatgacatattacctacatgtcattgcccatgatgcataactgtggggtaatataccaatttgaataacagatgaattttcattggaaaacatggaggctagaaggaagtgctacgtttttcaagtgctaaaagaaatgagctcttaatcatgaattctgtatctggtgaaacaatcccaacacaaaggaaagataaatggtttagatgatgtatatcccaattaccctgacttgatcattacacattgtaaacaggcatcaaagtatcacatgtacctcaaaatatgtacaactaatatatataaattttttaaaaggtaaaacaaaaagaataaaagagaaatgaagacaacctcagatgacagaaaaccataagcatttgttggtagcagacctatccttaaaaactggctaaaggaaattattcaaaaagataggaaatgataaaaaaaaaaaaagaatagtggaggatgaggaagaaagaaggaatgataaaaagagcacaaatatgagtatatacaacagtatatcctttacttattactttagctgataatatgattgaaacaaaaattataacaccatctggtgctcaagacaatggtattttaaagtgagtaaagcataaatggaagtgaggcttacacatcccacccaaagtggtcaaactttgatactacttggctgggataagtcacatgtacatttttttttaagacagagtctcactctgttgcccaggctgcagtgcagtggcgggatctcagcttactgcaacctctgcctcccgagttcaagcgattctcctgcctcagcctcccaagtagctgggattataggcatgtgccaccaaacccggctaatttttgtatctttagtagagattgggtttcaccatgttggccaggctgctgtcgaactcctgaccttaagtgatccatccacctaggcctctcaaagtgctgggattagaggcatgagccactgcgcctggccaagtcacatgtacattttaatgccaacggcgaccactaggaaaactataccatgggatatgctcaaaacactaagaataaatcaagaagaaattctaaaaactgttcaaattacccacacaaaggtaaaaaggaaatttcaaagaacaaagaacaagaactagaataaacaaatggaaaataaataatgtgacagacttggctatacttgcttataagttttttgagatctttaggaattccatctactacatctaaggtatcaaatttgttggcacagagttatttacagtatctttttaatatcattttagtgaccatggactcagtagttataacccctctttcatttctggtattggcaatttgtttttctactttcttggttagatagaggcttatcacttttatttgcatttttaaaaaaacaggttttggtgtctttttttcttattatctttctgttttcaatttcattgatttctgctccatttttaattatttcttcaattctacttgctttaggctcaaattattcattttattttattttattaacttttctaaggtaaaagcctagattttgaatgtagatatttattctttcctgaaacacagatttcatgttataatttccctctactactttcacagcaccccacaaactataaaaaagttgtatttttattatactgtatattttagaagggctctaggtttacagaaaaattgagaagatagcggaatttccatgcaccttacacacactttcccttatctttaaaatcctttattggcatgtttcatttgtcacagttaatgaaccaatataaatacattatgattaattaagtccatagtttatttatatttccttattttttaacctaatgttctttttttgttctagaataccacattatttttggttgtcatgtctttttaggttcctcttgtctgtggtaatttctcagactttgcttgttttgatagccttcacagtttcgaggagtaatggtcagttattttgtaagattccttatgattagagtttgatgatgatctcatgataataccaggttgtgggtaactgagagaaagccataaaggtaaagtggcatgttaatcacatcatatcgatgatacatactattcatatgatttatgattattgatgttggccttgatgaccttgctgagatagtatttgtcaggtttctccactgtaaaactcccccatttctatatcgtactctttgaaggaagtgacaatgtgcatcccatacttcacacttaagaactggggagttatgttccttctctttatctacataaattatttggaaatcttctacatgggagatttttcccttctcttcattcattcaatcatttatttatatcagtatagactcctgggtatttactttacacattgcattataatctaatgttactttattttgttgttcaaattgttatagcttttgtcattgggagctctttcagttggttcctatgcttctttaacaaacccccatctatgtggtagacttttttgtttgttgttttgcttgtataatagcattcccttattttctggttccacaaaatgttccatgctcatcatatatatataccgcaccagtcctagaatcatccatttctcaaaggagccctgattccttttattggaaaatagtattagaaaacaagagctgggtgctaggtgtgctcttttctactttagtgtcatttctttaaggcctcagcaaacagaaaaaaatatatgtgtggctactaacccacgtatataccaatatctataaatattttatataaaattatctgtatctatattaggctaaacataagttcatattgatatctccaactctaacccattgttacacgaatgactctagcctcctcccctttcttatctataaatttacattcctacggtcaggaaacctggtttctacctccatacatgtataacagtattagcatgattaacccatacctcataggagatacaactttatcaaatacagtggttatgagtagttacttttgcctttattcttatagacttcacttatttccagagttatttaagtaagcatcttccccctccacttccatggatttttttttcaagcacttgtaatacatttacattatcttgtcacagtctgcattcctttgcggaactttctgacctaagaaattttgttttaaatttacataccttaaggtttattctttgtgaagtaaagttatatgagtttttataaatacataatgttatatacccaccattgtagtattatacagaataaattcactgccctaaaaatcctctttgctccatctactcattactccctctcatctccaaacccctggcacccactgatcattttactgtctctatagttttgcctctatcttatgtcatataattggaatcattcaatatgtagcctttttagactgacttctttcacttagcagcatgcatataaggtacttctatgtcttttaatgatttgatatctcattcttatcactcaacaacattctgttgtatggatgtaccacagtttctttaaccattcaccgattgaagaacatcctggttgcttccagttgttggcatttataagcaaagctacaataaacatttgtttgtagatttttatttgaacatgagttttcaagttaataggttaaaatacctaaaagagtggtttctgggacttatagtaagactatgtctagctgtgtaagaaactgtcaaactctctttcaaagtgtctgtaccattttgcattcccactgcaatgaatgagactgttttttctccacatccctgccagcatattatattgtcaggtttttttgtgtacgtgttttagccattctaataagcatgtaacagtatttcattatggttttaatttgcaattatctgatgacaaattatattgagcatattttcatatgcttatttactgactgcatatcttctagcctctgatttaacttcataagtgaacttcatttggcaagtctctgaaaacttaacaaataaaaaatgattgatttttttaacataggtcctcaaacagttttcttttttggttggaagaacttctgaataaatgtctgagaattaagttatattaatttacaggggaaagacatgctattctggcttacattgacataatcatggatataaactcaaagatgcaagtaattgtcacaggcaagcactctcacattaacaggagagctctcctgttcttatcctacatctcaggccatgacttctctgtccatttctctagtctacttcccctgtgtctctcctttggactcccactgtagtctgtacagatttatatttaagaatctgcagttcctattttgttctttttcacttatgtatctgcctctgacacagtattgtgaaattcacaactgtaatagatcatgcttcattgatctttttatatccagcatacagaacacttctggaaataaggtgggcataactgagcctttgctaccataaaaattaatattttatagagaccacagataggaaaaacatacacttccaataggaacttcatataatgcatgctatttttgtaggcaccatttgtgtagcttttgagcatcaacttctgagcaaactattaagcaactgtgaagttttctgggaaaatctcactgatgaaagttttgtataatagcccacatggtaactggcaaacttctcatcaaaaagcctgacttaggcagaattttcaaaagcatctcaatcattaatgtaatattttagaattttcatgatacacataaatccattttgatgtttcttaacaatttatattttatcatccccccacccccagagaactatttcattttattctaatttcattatattatctcatctttaactcaaactcacttaaaaggaaatgttataacactatttaaaaggtgaaaaaaccccattatgtgtcatggcaaatagttcataaacttaatataataaaatataaaaagtataaaattctaaaaattaaaaactgaaatagaaatgatcagtataatttatttccttttactaagcactctgtaagtgctgtgtcatttaatcttcataattgcctttttgaactttgtgtaccactcaattcatcttggtgactgactaccacttgcctgagtgaaactctggaaagcacaaacaaacaagcaaacaaaaaaacagcctcttttgaaatgatacagagttgagctttaatactagtatctacaatctaccactatccaaccttataaaatataaaaatcttcactactcttcattgcatggatgaaataaacatataaagcaacaagcacagtgcctaacaaaaagcaaacactcaaaaataccagttattattattggcattattgttcaatagatgtacataacattaatgttcttagatttgagcgttagacaacatttcccacatattttcttgatgtttgaatacgtattttcctggaaataagtcttagtctcaaaaatgttaagtggctcaatttcttacggcttctacattctaatttcccacttcaatccccagcctatatcccattcggccaccagccagtttccctgactgaacaagctctctcacacctctgtatccattctctccttcatacacacacatgctagagaagtctctggttgttaataaagctttacattcttcaccatcttacgttttctgtgttcttttattttctgttgctatacactagaataaaatattgatgagagtaagctatctgtctgttgtgctccctgctatattcccagaggctgaaattgatcaataaatatttgttgaattaattacctgacctttgtactagtcttggatacacagttggatgcatatggggcttccacttaaactcttggaaacatggaaattggacaagttaatcttttggggaaggcccatcatccagagagaagagtacaaccaacacttcaggccaggatggaattctacctctctttctctctacttttttttatttttttgattttttaaattttattattattattatattttaagttttagggtacatgtgcacaatgtgaaggttagttacatatgtatacatgtccatgcttatgggtaggaagaatcaatatcgtgaaaatggccatactgcccaaggtagtttatagattcaatgccatccccatcaagctaccaatgactttcttcacagaattggaaaaaactactttaaagttcatatggaaccaaaaaagagcccgcatagccaagtcaatcctaagccaaaagaacaaagctggaggcatcatgctacctgacttcaaactatactacaaggctacagtaaccaaaacagcatggtactggtacctaaacagagatatagatcaatggaagagaacagagccctcagaaataacgccgcatatctacaactatctgatctttgacaaacctgagaaaaacaagcaatggggaaaggattccctatttaataaatggtgctggaaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcacgggcaaggacttcatgtctaaaacactaaaagcaatggcaacaaaagccaacattgacaaatgggatctaattcaactaaagagcttctgcacagcaaaagaaactaccatcagagtgaataggcaacctacaaaatgggagaaaatttttgcaacctactcatctgacaaagggctaatatccagaatctacaatgaactcaaacaaatttacaagaaaaaaacaaacaaccccatcaaaaagtgggtgaaggacatgaacagacacttctcaaaagaagacatttatgcagccaaaaaacacatgaaaaaatgctcaccatcactgaccatcagagaaatgcaaatcaaaaccacaatgagataccatctcacaccagttagaatggcaatcattaaaaagtcaggaaacaacaggtgctggagaggatgtggagaaataggaacacttttacactgtttgtgggactctaaactagttcaacccttgtggaagtcagtgtggtgattcctcagggatctagaacttgaaataccatttgacccagccatcccattactgggtatatacccaaaggattataaatcatgctgctataaagacacatgcacacgtatgtttactgcggcactattcacaatagcaaagacctggaaccaacccaaatgtccaacagtgatagactggattaagaaaatgtggcacatatacaccatggaatactatgcagccataaacaaggaggagttcatgtcctttgcagggacatggatgaagctggaaaccatcattctcagcaaactaacacaagaacagaaaaccaaacaccgcttgttctcactcataagtgggagttgaacaatgagaacacatggacacagggaggagaacatcacacaacggggcctgtcagggggtgggggactaggggagggatagcattaggagaaatacctaatgtagatgacaggttgatgggtgcagcaaactaccatggcacatgtatacctatataacaaacctccacattgtgtacatgtaccccagaatttaaagtataataataaaaaagaaattcccctacactttacaagtaaaaactgattgatttaaaaatgaattaactggagagattaatgaatgaatataagactgttaatccaattatttaagtgtttgggtgaaaagcataaacatgcaggaatatgaaatcaagcctctggacccacaaacagcggcattttcaagcacagacatgcaagttcataatcacaaggattcagtcctccagatgtgaatcctgctcctaattcctctactctttctccctcaaatttttttgtctcctctccttcttttctctctttctactgcaaatatgccctgtaaagcctacgaatgagaatttacattcttctgtttgtttgttttcctaggagacggttaagaacaagaaccagtttttacttggtctttacatatgctctatcagtcagttacactgcatgaaacatacaggcattgcagagggtttactaaatgaatgcatttcataatgaaacagtgatagcgaaaacacccactttcaaactggaggcagtacactagttgctttccacataggtatcctatgtgtggcttttgtgtatcaggagccatgcaaagtcttctagaagctggtagatgtcacagggatagaaagcagattcatttgtccatgggcctctacacagtgcatagcatggttttcagcacacaaaaaggggtaaatcaacattacttaacttagtcatatatatataccttttcaaatctgccacccccaaatataatgtaaactaaatatttcacaggaaaggaaaaataccatttgtcacgagtcaaactctaaaatagacggatgatgtaacagcagtatggaattttaaaatgtacattagtggctttcagagacacagggatttctttacaagactgtgtaaaatgtggggacaatgaccaatgtaggcaatggcctgtgatgcatgcctcttaaatcccagctctgcacttcccagctgtgtgaacaggggcaagtagtctatccttctgaacttaaatttcctcatctgtgaaactggaagaaagaaacttatgtaacagggaatttatgaaaactatcagtaagatatgtcaagcacctgatacatggtgggccctgaaacagcaattattatgtattctgatattttagttaagagaaaccgccttcagccaatataatttctttattagaattttagtaattccacacaataagaagttcatcggatgcaaaaatcacccttctgagatgtaggctggtagtaaaagccatttgatcaaagctaaagtgaaagaatctcagagtgtcatgggtgttccctcagagcatatctattgtagtttaggaaaactactaacacaaccactgattttcaaacttgcctcaaaataaataacatggaaaaagatggaaaaagggaaagggaaacctcatatttttcccatcttgtactcccagagaatggctggcccagagcccacagtcagaaacactcgttgatggtggaaatctctccagaactggctgagttcattggcagtatgagatgttttagtgtggaacagggaatgcagccatttcctgataacaattttgatacatgtatatgccttgctatcttcatctcatgaatttgtggagttttagaacagcttggtgaccctggaaagcctgttctagcctgtgggtacacagtgtcattgataagtaaactatcttcctcgtgggctggccggatgtctttgtggaggggaaggcatccttccaagactggaattctctcatgcagggactagcttgcataaaagaccctcctccagatccagcctcatcaagaccttgaagcagctgtaagcaccaatcattttatcccttcacaaggacttgaaacaaactccattcctctgcctttgcagaaattagtgttgaattttccagcatttggccaaaggagcaggagaacaacctttaagatgaggagcttctgaaagtgttaggagatgggaggaaaatgttgcagagatgtgtgcatgagaaacggggaggggagcagagagaactccaggggcaagttaagcagtgggggtctgcctatactgccgtctttgtggggtgttctcatcaataagcctggaagattccactcattcagctacttcctagtggtcagatactgggcaagttacataatgccttagatctcaatcttctcccttgtgaaaatgggaatgacaacgttgcatttgaagggttttcattagggttaaatgaaaaaggtacatgaagtgcctagtgtagcccatccataattatgtgtcctattacacaacaatagcgtccactttattttcaactctttcataacatcattctgcttgcattgtgtttaattatataatcgtgtttctttctgaaagccactatcatatgaaaataaaatacaatatgtaaatcacagtacatgtctacccagataaaaccagagagctgaaaacaccacctcaagtcatgctgtgtagtaggaactgtgctactctgtaaagaggtcatggaaaatgaatgagacttctgcccttaggtatctcacggctgcccagctgtgtttctgtggcatctggtacctatgtggtgccgacacaaatggcaactactggaatagctgcagactacaaagagaatgttttccctataagtgtcattttcaaaagattaattaattcaatgactattcagtagtgcccttctggttgtatcagagagtgtggatggtgggttcacaaagaccaacaaaacatggccctttccctcacaagtctcccatctagcacaggacacaaacacattcattacatccacaggtattttctgagtgactccagtgtatgctcagcagagatctgggctgcttgggatataccagtgagcaagagacaaagatccctaccatcaggagctaatactctagcaggagccatcattggctaggaaagagaacagcaataatcatcactaagtaattacatagtctgttagatgcaaaatactataacagaaaggaaacttgggccaaggaaaagaggatctggggtatcagcaacagggtggcaaggaagcgtgggtttagcagtccatcataaggtggcctgggtaggcctcatctagaaggtgagaagtgatcaaggcctcaaggtgagtgagcaagttatcattgtagatatgggaaaggagcattccaagcagagggaatggctagagcaaaggccttgaggagggaaggagcctgcctgacataacccagaagctgcagagtccaggtctgctagagatgtgtggctcatggggactggtagggacaaagtcaaagaggaaatgggccagatgttgtagggccttgtaggttttggaagcatttaacattttactctgatgcataaacacagggccactagaaagggtttggtttctgaattagaagtctctgcaaggtagggtaaagggaaaaggaaggtgacatcagtgagacaggatcaggcagtgagcaaagaagtgggagaaatcaaggcatgctccatcattatgagagaggcagcactcgcctggacttgacaattccacggatcactggggccacatccatgacctgtgcacatctataccattactcacaaaatcacaaaagtagcagttctgtgtgcattctgtcatttgtccaggaaacaaacaaacaaaacaatgagggaggttattttgtattccattcattttgtatttaagacctttctagggaactagctagtatagacccaaaatgaaaccgcctttgtgtttgaacaagagtgtcctaggtccatgaaggaagaaaacattagggaacgtacgaaggttgatgtgaaagacacaacttaccctgccttccccggtcctagtttcatttgtattttatttaatatcgctattaaatagttaacaggtaaaataacaactatcctttgtgatccatgtagatcctgtcatcatttctcattcaatcaatatgttttaaatccctgctggacaccagatcccaggcactgtgttgactcagagggcaacagacatgtttcaggctggttcccagtcctcaaatttctcacaagcttgcggaaaaatcatttcaaagctccttaattagagctaaaacagaattaaagtcaaggaagcctggaaaaacagagggtggtacctcaatcccaatataaaggaagggccagcacatggtcaggaaagctttcttgggagaggtgaggttctgagtagtgttattatccttctttacatctgagaaatattaaggtcaaagatattaacttgcctaaggctgcatagctactgagagagcaggatttaaattttagttcatgtgcatttcaaaacatcatttcttttctcatggactactaccaaaatcacttcccctggctctgcttcccttaagtattctgaaggtttctcaggtacgttgcagtccctctcctgatagctgggttttacccagctgtgattaccatcaagctcttagaaggtctttaacattcccaaccccaggtaacagctgtttctgcagagctcctctcttaggactgtaccccaattaaaacacagttagaaatgtcaccttccatggctttctcactaagtaaagcacccaacttccctgaggataattctactgttcctgtaaattttccatctgcctgccccttcctacctctgaaaaaaaaggcagaaatatgtatcctagacttgttggtttcagggtagatcctctaagcttttatgctagggattctggaaatgtacatggaagctccattctcttgagtgcctggatcttccaggtagaaaaaaactagaaaggaggaagaccataccaaaaggaatgacatgcactgtctatgtcagcaactcttaacataagggaaacatgccatagtaaacacaagatgattacatctggactcagacagaccagggtgtggatcccagctccaccacttcctggcttgctcactgtaacccatctcagcctgttaatctgttaaaaggggattttgatacttttcatgttttttggtacaaaaatattaagtgcacaaagaaagcagaccatccataaatcaccatcatggcctagtatgatgacagcatagaatgtcttcttttctgtatcacttcattgcattttatcttgcaggggaaatgaaagcttcaaatcatgaagtaacatttggaggtgacacaactattatttgctgggagtgagagaggtactcacatgttcttttcacattttgttcagaagaaaaacatgatggaaagtacctttctctggagtcagtgaatcttagctactgaataccttatccaaaaggtcaatgctgaatgtcatcaacgaaggccataacaaacaacagctgtggataagaagaatccttctgacaagatatggtgatgttcactggccatcagagaaatgcaaatcaaaaccacaatgagataccatctcacaccagttataatggcgatcattaaaaagtcaggaaacaacaggtgctagagaggatgtggagaaataggaacacttttacactgttggtgggactgtaaactagttcaaccattgtggaagacagtgtggtgattcctcaaggatctagaaatagaaataccatttgacccagcgattccattactgggtatatacccaaaggattataaatcatgctgctataaagacacatgcatacgtatgtttattgcggcactattcacaatagcaaagacttggaaccaacccaaatgtccatcagtgatagactggattaagaaaatgtggcacatatacaccatggaatactatgcagccataaaaaaggatgagttcatgttctttgtagggacatggatgaagctggaaccatcattctgagtaaactatcacaaggacagtaaaccaaacaccgcatgttctcactcataggtgggaattgaacaatgagaacatttggacacagggtggggaagatcacacaccggggcctgtcatggggtggggggaggaggggggggagggatagcattaggagaaatacctaatgtaaatgatgagttaatgggtgcagcccaccaacatgacacatgtatacatatgtaacaaaactgcacattgtgcacatgtaccctagaacttaaagtataataaaaaaatagatgaatggataaagaaaatgtggtacctatacacaatggagtactatttggctataaaaaagcatgagatcctgtcatttgtaactgcatggatgggactggaggtcattatgttaagtgaaataagccaggcacagaaagacaaacatcacatattctcacttacgtgtgggacctaaaaataaaaataactgaactcatggagttagagaatacaagaatggttaccagagggtgagaagggtagtgaggtgtggtggggaggtgggtatggttaatgggcacaaaaaatatagttagaaagaatgaataagatctaatatttgatagaacaacatagggactataatcaaaacaatttaattgtacatttaaaaataactaaaagagtattattggattgtttgaaacataaaggataaatgcttgagggattgcatgcctgtatcaaaacatctcatgtagcacataaatatatacacctactatgtacccacaaaaatttaaaaaaataaaaaattttaaaaagaaaaaaaaaagatacagtgatgttgtgggcatgcaggctatggagacaggaagccttgaactcaaatacaaactccactctgagtcctcattttctcttctataaaatggacttattaactgcctccctctctaagagttaatgggataacagttaaataggacacagggcataacacagagcctctcacagggactgtactcaacaaatgttagatgtcttaacctcatccctttctttctgactccaggaaaagttaaatgtcaacatctttaagtagacgttacgtttccacaaggaagaatcttttctctctctctctttggttggattttgatggatggctgttaatagttggagcagccattttttaatgcatatcaaaacaccccgaagttttgtactttaagcaacaatgaattattttgttcaccattgttcaagtcaattccagcttaggaggaggcagcgcacgatgatcaaatgatgcctcaaccagttgtcctccaaataggaacagcaaattgaccaactatccacacaaatgggcacctttatgagagccaaaaatcaggtgagtgatcacaggacctggttttaacttcatatcaccaaaaggggcaacgaggtgggtaggaagacaatcttgaattgccgatgccaccccctcccacaccctggcagcagccacctgatgcggagagagaatctgtgcatgtgggggagggagagcacagtgattgtgagactttgcattggaactccatgctgtcctgtcacagtgcaacacacaccatgaagaactcagctgacacccagggagggaacatttagaccagtcctagctagaggggtatcacccatcccagtggtcagaacccgagttctggcatgccctgccactatgggctaaagggctctgtggtgctaaataaacctgaaaggcaggctagaccaccaggactgcaattcctggacaagtccttgtgctaggctggactagtagacttggggggcacacagcctactgagataccagctgcggctgccaatagagtacatgtcccaccatctccccagcctcaggcagtacagctcacagcactaggagagtctccttccgtcctcttaaggagaagagaggaaaaagtaaagagaatcttgtcttgcaacttggttaccaagtcagccacagtagaagaaggcaccagggagagtcctgaggccttagctctgggacgacatttatagacacaccccgggctagaaggaaccagtcctggcaggagtcatcacctgctgaagagccctcaggccctaaatcagcagcagcagcacccaggaagtacttagccttgggtgacattcagggacatgctagcttcaggtgtgacccagcacattcctatctgttgtggctagggagagagactccttccgtttgagaaagtagagtgaagtttgaagaagattttggcttacaccttaggtaccagctcagccacagtggggtagagtaccaagtgagctcttgggatcgccacttccaggcttggctcttggatggcatttctggacctgccctgggccagagggcagtccactgccctgaagggagagtcccaggcctggcagcatttacttcaagctgactgaagagctcttgggccttgaatgaatattggcagtagctaagcagtactcgctgtgggcctgggacagtggtggccacaggaagagactcaactgcatgtagaaaggggagggaagagtgggaaggactatgacttgtgccatgcatgccacttcagccacagtaggatagagcaccaggtagattcttaaggtgtccaactctagtccctggctcccagatggcacttctggactggcccaggcactgagggaacttgccacactgaagaaaaagatacaagccaggcttgctccaccacctactgactgtagagccatagggccttaactgaacataggaggcaacaggtaaagattaacgtgagccttgggcaagacccgttgctgtgctgccttcaggtctgacccacctcagtcccaattgtggtggccacaggggtgcagctcagcatagagagagagactttgtttgggggaaagtagagagagagagagcgagcaagagtctctgcctggtattccagagtatttttctgggtcttatccaagacaaccaaggagggaacgctatgactctgaaaaagcagtgctcccaagtttgtggtgtccctaatgaaaatatggctgcaatgacccaaacttagattacaacacccgagtcccttagaatgcctgggaaggcttcccaaaagaaggatgggtacaaagaagcccagactatgaacactacagtaaatacctaactcctcaaggcccagacactgatgaacatccacaagcataaaactatccaagaaaagaggatctaaccaagggaactaagccaccagaaacaaatcctggagagatgtgggagctttcagagaattcaaaatagctgttttgaggaaactcaaagaaattcaagataacacagagaaggttctcagaatcctatcagataaatttaacaaagagatggaaataatttttaaaaatcaagcaaaaattctgaagttgaaataggccataaacttgaaaggcagtctaggccacaaggactgcaattcctggacaagtccttgtactgtgttggaccagcagacttggatggaacacaacctactgagataccagccggggctgccaatggagtgtgtgtcccacattgaaacatatggaagaatgcatcagagcctcttaacagcagaactgattaagcagaagaaataactcatgatcttaaaaacaggctatttgaaaatacacagtaaggccgggcacagtggctcatacctgtaatcacagcactttgggaggctgaggcaggcagatcatgaggtcaggagatcgagaccatcctggtcaacatggtgaaaccccatctctactaaaaatacaaaaattagctgggtgtggtggcatatgcctgtaatcccagccacttgggagggtgaggcatgagaattgcttgaacccaggaggcagaggttgcagtgagccaagatcgtgccagtacactccagcctggtgacagagcgagactccatctaaaaacaaacaaacaaacaaacaaaaacacagtgagaggagacaaacaaagaaaagaattaaaaatgaatgcagtagctagaaagcctcagaagggcaaatttaagagagttatttgccttaaagaggaggtagacagagagatacgggtagaaagattattcaaagagataatataagagaacttcctaaactagagaaagataccaatattcaagtacgagaacgttgtagaacaccaaacagattcaaccaaaataagactacctaaagacatttaataatcaaactcccaaagatcaaggataaagaaagaatactaaaaacactaagaaaaaagaagcaaataacataaaatggagctccaataggtctggcagcagactattcagtggaaaccttacaggccaagacagcatgatataaagtgctaaaggaaaaaaatttaacctagaatagtatgtccagtgaaaatatccttcaacatgaaagagaaataaagactttcccagactaacaaaagctgagggattttatcaacactatacgtgtcctacaggaaatgctagacagagttcttcaatctgaaagaaaaggaagttaatgagcaaaaagaaatcatctgaaagtacaaaactcactgttaatagtaagttcacataaaaacacagaatcttatagcactgtaattgtggcatgtcaactactcttatcttgagtaaaatgactaaaagatgaacatcaaaaataaccacaacaacttttcaagacatacacagtacaatatgatataaatagaaacaacgaaaagttaaaaagcaaggggatgaagttaaagtgtagagttgtattagttttctcttttttagttagtttatgcaatgagtgttaagttgtcatcagtttaaaatgatgggttatattatttgcaagcctcatggtaacctgaaatcagaatgcataccacagatccagaaaacatgaaaagcaaaaaattaaaccatatcactaaagaaaatcaccttcattaaaagaaagataggtaggaaggaaggaaaggaggaagagaagaccacgaaacaatcagaaaacaataaaatggtggaagaaagtccttacaaatcaataataacactgaatataaatggactaaactctccaatagaaagacatagagaggctgaatggattttaaaaaactatacccagtgaccacttgcctatatgaaacatactttacctataaatatacacataaacagcagttaatggaatggaaaaagatattccatgccaatggataccaaaaaaacaagcaagagtagctatacttatatcagagaaaatagtttcaatatagaaactataaaaaagacaaagaagacaattgtataataatcataagttgctcaattcagcaagagggaataaaaattgtaaatatatatgcacctagcactggagcacccagatatataaagttaatattattagagctaaagagagagagataccccatcatgataataggtagatacttcaacatcccactttgagcattgaacagaccatctagaccgaaaaccaaagaaacatcagcattaatctgcactacagacctaataaatgtacctaatagatatttacagaacatttcaaacaatggctacagaatacacattcttctcctcagtgaatggatcattctcaaggataaaccatatgctaggtcacaaaacaagacttaaaaattgaaaaaaaaaatgaaatgatatcaagtatcttctctgaccataatggaataaaactagaaacaaataacagaaggaattttgaaaactatacagacatttggacattaagcaatatgttcctgaatgaccagtgggtcaatgaaaaaattaagaagaaaattgagtcaggcgcagcagcttatgcctctaatcccagcattttgggaggccaaggtgggtgtatcaccagaggtcaggagttggagaccagcctgaccaacataatgaaaccccgtctcttaccctaaaaataaaaaattagctgggtatggtagtgcatgcctgtaatcccagctacttgggaggctgaggcaggagaatcacttgaacctgggaggtggaggttgcagtgggccaagatcgcaccattgcactccagccttaacaaaaagagcaaaactccacctcgaaaaaaaaaatagtgattgaaacaaatgataatggaaacacaatataccaaaacctatgggatacaggaaaataaatattaagatgaaagtttatagttaaaagtgcctacttaagataaaacaacttcaaataaacaacctaacaatgcaccttaaagagctagagcagcaagaaccaatcaaatccaaagttactagaagaaaagaaataataaagaccagagcagaaataaatgaattgaaatgaagaaaagaatacaaaagatcaatgaagcaaaaagttgcctctttgagaagataaaattaacacaaatttattcaaagtaactaataaaaaagagagaagactcaaatcaataaaatcagagatgaaaaatgaaatattacaactgataccatggaaattcaaaggatcattgaagagaaaagacattctcttcaataaatggtactgggaaaactggatatccatatgcagaagaatgaaactagacctctatctctcaccatatacaaaaatcaaatcaaaataaagtcctaaatctaagaactcaaactatgaaactactacaagagaacattgggaaactctccaggacatcagtctgggcaaacatttcttgagtaataacccacaagcacaggcaaccaaagccaaaatggacacatgggatcacatcaagttaaaattattctgcacagcaaaagaaactacaaaaaaattaaggagacaatccacagaatgggagaaaatattttcaaactatccatatgacaacagattaataaccagaatatattaagagctcaaacaacacaataacaaacctcatacactgttgctgggaatttaaagtcatacaaccattatggagaacagtttggagattcctcaaaagactaaagacagagttaccatatgttctagcaataccactgctaggtatccaaaggaagcaaatcagtatatggaagagatatctgcacctgcatgtttattgcagcactattaacgatagccaagatttagaagcaatctaagtgtccatcaacaggtgaatggatacagaaaatgtggtgcatatacacagtggagtactattcagccattaaaaaatgagatcctatgatttacaacaacatggatgaaaatggagatcattctatgaagcgaaataagccaggcacagaaagacaaacttggcatgttttcacttatctgtgagagctaaaaattaaaacaatcaaactcatggagataggaagtagaatgatggttaccagagactgagatgggtagttggtaggggtgaagttgtgggggtggttaatgggcacaaaaacatacttagaatgaataagatctactattttataccaaaatagaatgactaaagtcaacaatttattgtacatttaaaaataactaaaagagtataattggattgtttgtaacacaaagaatggataaatgcttgaggtgaaggacgccccatttaccctgatatgattactatgagctgtatataccatgtactctataaatataaaaaccacaattttttttctttctttttttttttttaagacagagtctcatctgtcgcccaggctggagtgcagttgtatgatctcggcacactgcaaccctctgcctcctgggttcaacaattctcttgcctcagcctcccaagtagctgggactacaggtgtgtgccaccacacccaactaatttttgtattttttagtacagacagggtttcgccacgttggctagactggtctcaagctcctgaactcctgacctcaggtgatccacccacctaggcttcccaaagtgctgggattacaggcatggcccaccacacctggcccctaacaaaaatttaaaattaaaaaaaattccagctgggctcatctcagttgttctgctgttcttggctaagcttacttacgcatctaaggatagttccctcttatgacctatttagttcttctggggccctaatagtctaggatggcctcacccatatgttgcacaatgggatcactgtcacttggggtgaaggggatgaatggcccatggatcttagatgtgacacaaaagtacaatctgcaacacaatgcccaacataaaaaattgttaaatttgatttcaacgatgttaaaaattgttcctcaaaaacagtaatagaaggaaaagtcacagactgcaaaaaaatcttttcaaagcatatatctgataaagaacttatatctataatatataaagagttatcaaaactcaacaataataaacaaccaaattaaaaatgggcaaaggatttgaaaacatgtcaagtaagcacaggaaaatatgctcaatatcatttgggaaaatgcaaattaaaacccaaataagaaaccactacatacctattacaaggtctacaattttaaaaagctgaccataccaagttttatgagaatgtggaggaactggaactctcatacactgccagttgaaatgtaaaattgtacaaccactttgcaaaacagtgttttagttacttaaaaagctaaacatatacctatcatatggtccagccattctactactatgtatttaccaaagaataaaaaatatatatgtccatgtgctatggtttggataaggtttgtatgtccccaccaaaactcatgttgcaatttgatcctcagtgtggcagtgttgagaggtagggactggtgggaggtgtttgggttgtggggacagatttttcttgtttttttcttgtaaatttgtttaaattccttatagattctagatattagacttttgtcagatgcatactttgcaaaaattttctctcaatctgtaggttgttcactctattgtcagtttcctttgctgtgcgaaagctctttaatttaattagataccatttgtcaatctttgctcttgttgcaattgcttttggcatcttcctcaataaatttctgcctgttcctgtgtctagaatggtattgcctaggtcgtcttccagggtttttataggtttgtgttttacatttaagtctttaatcaatcttcaattaaattttgtatgttgtataagaaaggagtccagtttcaatcctctgcatatggctagccagctatcccagcaccatttattaaatagggaatcctttccccattgcttatttttgtcagctttgttgaagatcagatagttgtacctatgaggccttatttctgggttctctattctgttccgtttgtctatgaatctgtttttatacctataccctgctgttttggttactgtagccctgtaggatagtttgaattcaggtagcatgacacctccaacttcgttctttttgcttaggattgccttggctattcaggatccttttagttccgtatgaatgttaaaatagttttttctacttctgtgaaaactgtccatgcttgtttaataggaatagcattgaatctataaattactttggacagtatggccattttaaaaaggagcatggaatgtttttccatttgtgtcatctgtgatttatttgaggagtgttttgtagttctccttgtacagatcttttacctccctggttagctatatttccagttattttattatttctgtgacaattgtgaatggaactgcattcctgagctgcactcctcagcttgactgttgtttgtgtatagtaatgttagtgatgtttgcacattgatttggtatcctgagactttgctgaagttgtttatcagcttatgaagctttgggctgaaactgtggagttttctagatataggatcatgtcatctgcaaactgggatagtttgacttcctctcttcctatttggatgtgctttattttttctctggttgcccttgccaggatttccaatactatgttgaatagaagtggtgagtgagggcatctttgccttgtgtcagttttcaaggggaatgcttacagcttaggcccattcagtatataatgctggctgtgggtttgtcatagatgtctcttattattttgaggtatattccttcaatacctagtctattgagagcttttaacattaaggggtgaattttatcaaaagacttttctgcatctatttagtaatcatgtgatttttttatctttagttctgtttatgtgatgaatcacattcattgatttgcatatggtgaaccaaccttgcatcccaggataaaacctacttgattatagtggataagctttttgatgtgctgctggattcgatttgccagtttttcttgagaatatttgcataaatgttcaccaaggatattggcctgaagttttctttttttgttgtgtctctgccaggttttggtatcaggatgatgctggcttcatagaatgagttgaggagaagtctctccttctcatatttttttttcctgaatacttacagtaggaatggtatcagctcttctttgtacatctggtagaatttggctgttaatctatctggtcctgggcttttttttggttggtaggcaatttattactgcttcaattttagagctcatttttggtctattcagaaattcaatttcttccaggttcagtcttgggagggtgtatgtgtccaggaatttacccatttcttctagattttttactttatgtgcatagaggtgttcataatatactctagtggttcactgtttttctgtggggtcaatggaaatatccctgttgtcatttctgattgtgtttatttgaatcttctctcttattagtctagctagtggtctattttattaattttttcaaaaaaaaacagctcctggatttgatcttttgaatggtttttcatgtcttaatatctgtcaattcagctctcattttggttatttcttgtcatctcctagctttgggatttgtttgatcttggttctgtagttcttttagttgtgatgttaacttcagatctaactttttgatgtgggcacttagtgctataaattcctctcttaacactgccttagttgtgtcccaaagattctggtatgttgtatctttgttctcattagtttcaaagaacatctttattgctgccttactttcattattacccaaaagtcattcagaagcaagttattcaatttccatgtaattgtatggttttcagtgaatttcttagtcttcatttctaatttaactgcattgtggtccaagagattgttatgatttcagtttttttttaatttgctgaagagtattttatttccaattatgtgattgggattttagagtatgcaccatgcggtgatgaaaggaatatatattctgttgttttcatgtgcagaattctttagatatctatcaggtccatttgacctagggctgaattcagggttctgaatatctttaattttcagtcttgatgatctgtgtaatattgtcagtggggtgttaaagtctccgagtattactgtgtgggagtttgtctctttgaaggtctgtagtaaattgctttacaaatctaggtgctcctgtgttgggtgcatatatatttaggatagttagatattcttgttgaactgaaccctttaccattaggtaatgcctttctctgtttctgattttgttgttttaaactctgttttgactgaaactaggactgaaactaatcctcactttttttctgttttccattgcttggtagatttttttctccatgcctttattttgagcctatgtgtgtcattgcatgtgagatgggtgtcttgaagacagtataccaatgggtcttggttctttatctaccttgccactctggagcatcttaattggagcagttagcccatttaaatttaaggttagtattgatatgtgtaaatttgatcctatcatgatgttagctggttactttgcagacttgtttatgtggttgctttacagtgtcactggtctgtgtacctcagttttttgtagtggctagtaatggtctttcctttccatatttaatgcttccttcaggagctcttgtaaggcaggtctggtggtaacaaatgccctcagcatttgtctaaacatgatcttattttttcttcacttataaagcatagtctggctggctatgaaattctgggttggaatatattttctttaagattgttgaatattggcctgaatctcttctggcttgtacattttttattttgacctttgagaatctgatgattatgtgtcatggggatagtcttcttttgaaatattttactgggcttctctgcatttcctgagtttgaatgtcaatctctttagctaagggaggttctcacggatgatatcatgaaatatgttttcgaagttgattccattttttcagggacacagatcagtatagatttagtctgtttacataatcccatgtatcgcagagattttgttcattccttttcattctttcttctctattcttgtcttatttcattttttaaattttattatttattttttcaaacagagtctcactctcagtcaggctggagtgcagtggctcactgcaacctcttcctcccaggttcaagcaattctcatgcctcagcctcccaagcagctgggattataggcatgtaccaccatgcccagctactttttgtatttttggtagagacagggtttcaccatgttggcaaggctcgtctcaaactcctggcctcaagtgatctacccacctcggcctcccaaagtcctgggattagaggcatgagccaccacacctggccctgactatcttatttcataaagccagtcatcaagctctgagattcttttctttgcttggtctattctgctattaatacttgtgattgctttatgaaattcttgtagtgtgcctttcagctctatcaggttggatatgttcttttctatactgtctattttgtctgtcggctcctgttttatcataatttttagcttccttggattgggtttcaatgtacccctattgctcaatggccttcatttctattcgtattttgaattctatttctgcgatttcagctatctcagcccagttcaaagcttttgctggagaggtgatgtggtcatttggaggaaagaaggcattctggctttttaagtttccagggttcttgcactgattctttctcatctttgtgggcttatctaccttcaatctttaaggttgctggcctttggtgggtttttttttttcttcttttatcctacttgatgactctgagggtttgattgtagtatgaggtggattcagctgactggcttggtttctgaaagatttgatgggaccaatgcacagttctcaaatcctggactgcgtactctaattctgggggacttggattgggtcctgactttgttctctggctccttgagattaggaatacactgcactgggacgcaaggtgcagtagctgtggcagagttctagcaggtgccagggtacctgcctccctgcaggcattcaatacagtggcagaagcaaggcagctagggaggggacagggagctactgctggcaactgcgtgagcagtgtgctgaaggtggtgttggctcagcagtggggcgctggcaggcaccggtctggatgctttctttgtaccctgcaagcaggagtgatcactcagggtgggagatgatctgctcttctctgtgcagtgttagcacaagggtggggtgctggtgggggaagggctagctggctctttggccaggggtggggggctggactgtactcctgcacattagccagacaagaaaagcaaaactcacccatgcaaacaggtgccagcaaagtgatgtggggagttgctgtggtcatgggggaagctgctgtatggggagggagtaggtgggctgttgtgtgtctgtaggggctgccctgctggagttggagctctccaccagtcagtcatggtccaccagcacagaagctattgtgtgggcccccatagcacctgagactgcacgcaagcaggaatgaccaggctggggtcccaggagaggccagcaaaccaaggggtgctcaggtcggaccagccttgactgatgggcaagaccaccctgcagagttcaggtctgacagctcccctaggtctagagtctcctataggaagcaattcaagcttagggtaatggccatctctggccatgctctgctacagacacttttgcaccaaaccgtgtgagctccacgtcatctagtttgctgcccctaccacttctctattagctttccctgctaactctagtttctctggtggttgaagggtctcctcctgctgggttccagaggcccgtggtgaaagtgggttgctctttgccagttcaactcacccaattcccctcaagccattgtgggccaggaatgagtcccagtgaggggtagccccacgtagggttcccagctttctccctcttcagcccagcttcggtgtcttccctccatccactctcagtgccttccctctgaagatctgttaggagcacaccaatcatctgggtccctaagtgggagccattccacctggctgcatccagtcggccatcttgccctcctcccctcttttctttataaattactcagtctcaggtattctttcatagcaacatgaaacagattaagacaccaagtaaaaagtttcacctgaaagtctattgaagctttatttgtgatacccctaaactggaaataacataactgcccattaactgatgaatggttagttgtggcatagtcatacgatggaatattagtaataagaaggaaggaggtattgacacatgcgatatggataaatctcagaataattatctgagtgaaagaagcaagaaataaatacatagtgtatctgattccatttccataaaactctaggaagtgcaaattaataagaaaataacagaagtcagttcaatggttgcatgggtttaaggagtggtgggcagagtgttaagtatgaattacaaagggtcaaaagaaaaacttttaggggtaatgaatacattaattgtcttgaatatagggatggttttacaaatctatacatatgtcaaaacttcaaattgtacaattttaacacacaagacttattatatgacaattatatcacaaaaaaactgttaaaaatggccatgagggaaaatttatggataacaaaagcattcttgaactggattgttgtgatgtttatgcaactgtaaacatttcctaataagttatctcaatttagggttacaatggatgatccttttggtatattaactataatgtagtaaaacaatttaaaaattactagatattttccctttccttggtgatttggtaggcaggattttatgctgtgaacgggtatggtgagagataaaaggtgagaggattggtctgatgagagattttgaaaaggctgtgtgcagaatgagagagagtacttactgaagaaacatggaaagcttttcaggcagcacacatggcccaggtaaagcacatattaagtactccaaaataccaattaaaggagaaaataatgcataaagttacttatacaactaatatttattgagcacccaccatgtaacaggcactctgttagagacaatgtttaatttcaatcactaatttttgcttcattcacttactatactacaatgttcaccttgtaagaccccaatggcttttgtagtattaattactgctaaagtgaatatctctttttatttaagtatctgcctacaaacaaatggaagaacattccatgctcatgggtaggaagaatcaatatcatgaaaatggccatactgcccaaggtaatttatagattcaatgccatccccatcaaactaccaatgactctcttcacagaattggaaaaatctactttaaagttcatatggaaccaaaaaagagcccgcatagccaagtcaatcctaagccaaaagaacaaagctgggggcatcatgctacctgacttcaaactatactacaaggctacagtaaccaaaacagcatggtactggtaccaaaacagagatatagaccaatggaacagaacagagccctcagaaataatgccgcatatctacaactatctgatctttgacaaacctgacaaaaacaagaaatggggagacaattccctatttaataaatggtgctgggaaaactggctagccatatgtagaaagctaaaactggatcccttccttacaccttatacaaaaattaattcaagatggattaaagacttaaatgttagacgtaaaaccataaaaaccctagaagaaaacctaggcattaccattcaggacataggcatggacaaggacttcatgtctaaaacaccaaaagcaatggcaacaaaagccaaaattgacaaatgggatctaattaaactaaagagctcctgcacagcaaaagaaactaccatcagagtgaacaggcaacctacagaatgggagaaaatttttgcaacctactcatctgacaaagggctaatatccagaatctacaatgaactcaaacaaatttacaagaaaaaaacaaacagccccatcaaaaagtgggtgaaggatatgaacagacgcttctcaaaagaagacatttatgcagccaaaagacatgaaaaaatgctcatcatcactggccatcagagaaatgcaaatcaaaaccataatgagataccatctcacaccagttagaatggcaatcattaaaaagtcaggaaacaacaggtgctggagaggatgtggagaaataggaacacttttacactgttggtgggactggaaactagttcaacccttgtggaagtcagtgtggtgattcctcagggatctagaactagaaataccatttgaccaagccatcccattactgggtatatacccaaaggattataaatcatgctgctataaagacacatgcacatgtatgtttattgcggcactattcacaatagcaaagacttggaaccaagccaaatgtccaacaatgatagactggattaagaaaatgtcgcacatatacaccatgaaatactatgcagccataaataatgatgagttcatgtcctttgtagggacatgaatgaagctggaaaccatcattctcagcaaactatcgcaaggacaaaaaaccaaacaccacatgttctcactcataggtgggaattgaacaatgagaacacatggacacaggaagggcaacatcacacactggggactgttgtggggtggggggaggggggagggatagcattaggagatatacctaatgctaaatgacgagttaatgggtgcagcacaccaacgtggcacatgtatacatatgtaacaaacctgcacgttgtgcccatgtaccctaaaacttaaagtataataataatttttgttttaaaaagtgcacctcaaaaaaaaagaattctataaatgctatgcaaagtaatttttataactgccttgtaaatgttgaccactcaactcatcttggtcactaccagttgcctgtttacaattctggaagcacaaagttgtgaaaaagaacaagggttttgaaatttgacagactggacatgggcttcaatcctaatacctggaatctactgctatccaaccgtataaaatataaaaaccctaactacttttcattgcagcggatgaaattaacatggaaagcaactagcatatggcctaacaaacagcaagcattcaaaagtaccagctgctattattgttcaagaaatgagctgaataacattaatgttttcagatttgagctttacactacatttttacacatgatctcagatgtctgaatccttgttttccgagtaaaaacactaagtctcaaagttaagtggctcattttcttgtggattctactttctaatttctcacttcaactcccagcctatatcccattctaactccagacacagcaaactcctccaggtcctctgaacttagcaaccctcctctcacctccatatcaactctctcctccaaacacacacatgctgtataattttctatttgttaatcaagctttactttctttaccatcttaagttttctgtatccccttattttctgtctttgtgcaccagaatggaatatcaatgagaggaggttatccatctgttgtactcactgatatatctccggaacctataaggcctatagtaagtgatcaataaatagttgttgaattaattactgaacccttgaaacagtcttgcatacatagtttggcacatatgggactcccatttgaactctgggaaacatggaaattggacaagttaatcttactgggaaggctcagcatccagagagaccaatacacccaaagctactagagtcagatcaggatggaattctacctcactctctcttactataatagttgtataaccttgggcatgcttccttacttctctgggtctcagtttccttctctcattaattatcctcatgagatatttgaaattattcaatactttcgttcatcccttcagcaaacatttattgaatgtctcttatctgacaggcaccatttcaggcattggggtaagttggtaaataagtcacatctatcagctctcagtctaatggaggacacaaataattgtttatagaacagtggatgtgctgctatgataggggaaatacatggttctggtggcaggggttgtaggagtagttgctgctcttcgcttaatcttttttgtttcctcatgaatactggtgaagtctcaccagtcatcaaggcctaaggcctgcctgcttctggaatcattcctccatatttgtactttcacaagctctgtgattctgtggatcttactttggcttgacaaggctataagtgtcaacttgaaatttttcacagggcaaaacttattcactgacaagagtatttgatagtaacaaaatgatgataaaatagctaacacttattttcaaatggccttatggattctggttttattcactgggtcacaacctattattattattattattattattattactcattctaatgttcaaatggtcaaattacaaaaattacttttgtgccacattctttgctaaatgttttcaataacttattttaaacctcacaacatacctaaacaaaaatcctatttttatgtgcatttacatattgggtaaatagaattaaggaaagtttggagggtttcaaagtcatattgtcagtagagacaggtgattcagagtgcagacttgcttgtaaaaatcattccacactaaaacaaacagaggcgctttagagaaatgtctgactcaaaggctggaacagggaaagtacaaacagccaggaacatcttgttgcactagaaagtaaagaaagtgttccagctaagataaagataggacaataacatgcaggaagtttcaaggagcttcaactagcccaatctgggccaatttgaatatcaaaataaattttgatgataatctgttattacccagtgattaaatatatacccatgagcccataatgatgtaagtaaatacataaataagctaataaatgaggaagatgtgtgtgatggttaatattgagtgtgaacttgattggattgaaggatgcaaagtattgttcctgagtgtgtctgtgagggtgttgccaaaggagattaacatttgagtcagtgggctgggaaacgcagacccaccctcaatctgggtgggcaccatctagtcagctgccagtatggctataataaagcaggcagaagaagatggaagagcagacttggtgagtcttccggccttcatctttctctcgtgttggaagcttcctgccctggaacatcaaactccaagttcttcagcttttggactcttggacttacacctatcatcttacaccagtcgtctgccaggggctctcctgcctttggccacagactgaaggctgcattgtcggcttccctacctttgaggttttgggactcagactgatccaccagtggcctccttgctcctcaacttgcagacggcccatcatgggactttacattgtgatcgtgtgagtcaattctccttataaactccctttcatataggcatatatcctattagttccgtccctctagagaactgtgactaatacaatgggaaagctcttcatgacagtacaatgccaacttattaagtgttgaaaggctcttgtcactcccgtgttcatcgcagtactattgaaaacagttaagatatggaatcaaactaagtgtccaacaatagatgaatgaatcaagaaaatgtaggagataatggaattctattgagccttaaaaaagaaggaaatcctgcctgagcatgatgatgcatgccagtactcccagcactttgggaggctgaggcgggaggattgcttgagcccaggaatttgagaccagcctgggccacatagtgagatcctgtctctacaaaaaaataaaaattcatatggcatggtggcacatgcctgtggtcccagctactcaggaggttgagttgggacaatctcttgggtcccagaggtcaaggatgcagtgagccatgatcacatcactgcgctgcagcctgggtgacagagagagaccctgtctctaaaaaacaaaaacaaaagacatcctgtcatttgcgacaacctggatgacattttgttaatggaagtaacccaggcagggaaatacaaagactgcaggatcttatttatgtgtggaatctaaaaaggttgaactcgtggaaggagagagtagaatcctagctacaaggaaattgagaggaggtggttggtgagcggttcatcaaggatccaaattttcagttagataggaggaataagttcaagagacccactgtacgttatggtgactatggttaataacactgtattgtattctcgaaaatcactgagagtagattttgtgttttccccacaagaaatgttaagtatgagaggtaataatgtacatgttaatgagcttgatttagccattccacaataaatacatatttctgaattcaaagtttttgacctgtaagaaaggataatcattgagcttacctacctcctagggccatggtaaggattaaacgagatgatgcacatatgttttcagcaatatctcggacagggcgagtacacaataaaagttaactcacattgtttttttattccttttggtttttagaggacaacatttgattagacagttctggttccaaggactcagatctaaccatgtctctgaggtgcctaccagagataagatcctaagttttgagactcatataattaattactcaacaaaggatacctttcatccttattaaaattattggcccaaacatttctgatcttaatatctagtctcttaccattccacttagctgcctatgtgttttcctggagccaaatatcctcactttaacatttagtgtgtactaaggtccctaggcttctatatgtgctacctgtatgttcagtgggaatgtaactattttcagccatccttctgactagcccaatgtaccatagtaaaaatatctgccattcatttggagcctaaatataccatgcacaaaaattctggggagcagattttatatctatctcctttttcaaagtgaatacacaggctcagaggggtggagagactttctcagagtcacagagccaataagaggtggtacatgaaatgcctcactgcaatacccagggccttgctgcataactgagctgtattcagttctaacactgtacactattattaggcactatcttctcaactagattctaatctcagtgaaggtagacagcaaaatttagtgctcatggatacgccggtaccttcttcacgcctaagcacacagtaggtatccaaggaatatctgttgtctctttaatgtggaaaagagggcttgcttttaaatatttctaaaagcctctataaccaagttaaataaggttactctttaagtgtactctaaaaactctgagcagaaatatgattctgtaaaaattgctacaaactaaacaagatagtttagagttgtttacacaggtgggaaagctataataagcagcaaagtagagattctaaacaatgagcaggatggtaggaacgtccattgaggaaacagacagttgtggcagggaaagggacataaggggttctagcgttttatcaatatttcatttcactgttttgggttgtggttacacaggctttcgctttataactattcattatttatctttgtatatccgttttatgcactttaagctgaaaccaagaaaaaagaataagattgattccaggtcaaagaaacaccaagatttgaataaaggtattaatatggccacatgaagaatgtatcagtcaggagggggtttgtcagtcatccatgaaaggaaatactggaaacacccatataggcattgtgtgggaaaaacaagtctctacatgatttctggtcccactgtcaaagcattacctagtatgagatggaaatattgaatgatgctagcctcataccattaacagacaaaatgtatctatgcaagatgtcagctctttccccatcttaattaccttaattaaaccgattaataaccttaatgcatttcttttcattttgtaacacttgtgtaccagaaattacctctttttcaggctcatagacacacacacacacacacacacacacacacacacatccaatcacaccagggcactgatgtatttcagtggacattgtcattgactccccaacatccattctgtcttctgtttatctaagccagtcatggcaattccaatattcttgacattcactggttttgaaacaggcatgtgacctaattcagtcccatatgttggagttgattgtggggatatcttctggaaaatactatgtcacaggtcttgcctctttgaaagggcacattggaagatatattcctttctgtctgtaaacattaccatgtcaaaatcagagacctaaaagtgcttcagccacattgagaccagtacgttaagggcattgagagtggcacagaagagaggaaaaaaatctgaacccttcaaggcatccttgagctggagttctccttgcatggaatccacctacttttgatttcaggtctattttggaaatagaccaaatatttaatgaagaataactaactgccaggtaccatgtgggctctaaagatactacagcaaacaaagcagacaactgtgtctggtctcatggaactcatattttcatgtaattatacaaacagtaaataaaacaattacatccaattgtatgtcataagattataatggtatggaaaaagttagaggaagttaaagatctggaaggcagagaagttggatagggctgagaagttggagaggatagggctctctctcaatgtgacatttgagcaaaatctaatgaagttgatgaaatgaaccattaaatatgtggaggaagaatatttcaggcagagagaacagccagtaaaaagcctttagttgaaagtatgactatcataggtacggatgatgtagtgggatctagtgggggagttgttggattttagagaagtaacagaatatcaaatcacataggaacttgcagcccatgccaatgctttgatattttttttctctcaattagaccgagaacaatgacagaggagtggcataatctgacccaggtttcaaaaggatacctctggctgctgggatgagactaatcattagaaacaaaggtatagggaaatgaaccagtaaaaatgttattgccataatccaggcaagaaattgtagtggcttacaatgaagtggtacagtggagggggacagaattgctcacattctcaatatatttagaatgcaggcccaacagtatttccggataaatttaatgccaagattgacaccactgtttctaagtgagcatctaaaaagataaggttaactttaactgaaatgaggaagaatgaaagtagatgaaatcaggggaatgaaataagatatccaatttttacacagttaaaatcaaaatgtttgtttaacatgcatgtggacttgccaagtgggcaattggaaacagactgtggagtttaggtcagctatctaaactggacagagatgagagtgtagatcacataggacaccacactactggataagatcaccaaggtaatgagtgtaggcagagaagagaaggagaccaaggattgacttctgaggcacttcaatgtcaagagatcacgaggaaaggaggagaatcagccaaggagactcaggagttacagctaatgaggtcacagaaaaaccaagagagtattgtactagaattcaggaaagaaaggacttccgggtagagggattgatcaactctatccaatatatgtctcatatatatatatacatatttgagacagggtttcgctcttattgcccaggctagagtgcaatggcgcagtctccactcactgcaacctccacctcctgggttcaagtgattttcctgcctcagcctcctgagtagctgggattacaggcctgtgccaccacacccagctaatttttgtatttttagtagagacagggttttcccatgttggccaggctggtcttgaactcctgacctcaggtgatccctctccttggcctcctaaagtgctgagattacaggagcaagccaccgcccacactaactctatccaaaagtataaataggtaaattaaggagaagactgcgaaatagccattcgatttagaaatattggtgtcatggttaccttgacaagaacagtttgtttagtggaaggtgcgtaggcctggctgaagtatgattaagacagaataggaggagagaaatgggacacagtgaccatagacaacgctctgtgggaagcttgcaattggggaacagataaatggcactaagcaagtaaaaggagtgaggtaaacaggtttttggtgtttgcattttttttaacatggcaaaaataacaccagtatgtatgttgacaggaacaacatagtagaggaagaaaaagtcatgtcatgaggatgttacaaatgctgtgagattatgaacttgctttttgatttagccagtctaagtaagatttttctgttaggtgtaagcaaaaaaaaaacaaaacaaaaaaaaacaaaactgtcatgtagtgagcaattggcttgatatgtctgactttttgtcttatgccaattgtggaggcataattttaatatttctctctttgacgtgtttgaatgataaattatatggtcacaataattggataggaagactggttctacagtcatagattccaatcctgggcctgccacttaaaagatgtcatttaggataaattacttagcttctgtgtgttatacaaaatgtcttcctatgaacatagggataataaaggtacttaggaatcaaatgaggtaaagcatttaaagagcttgtagaagaacttgctatgtggtaaaaatttcataactattaaaagtctgcatgccacatggtaaaagttcccttttgcagtaaagaacatcaactgcctgattaactgttttgcctattcacacatataaccttaaaattaataaacatgaaactaacaaagtaaaattattcacagctccattttataggtatgaaaacagggaaatagatcatttaagataaaaagggaattaaaatataatggttaatttacaagctgtgtcaagacgcttggtgttatggttaattttatgtgtcaacatgactgagccacggggtgcccagacatttgagcaaacataatcctgggtgtgtctgtgagagtgacaagttgatttcagccttgcaaggtcctaaacggagaacacagttgatccatggcagacttatggaaactgtgaaatgataaatgtatgctgctttaagccactaagtgggtggtaatttttaatgaagcaataggaaactaatatacaggtatttaagttattactatatggaatctgttgtggttaaagtgatgcactgcgttgtctaaaccactgcggaggatgaagactaatatctggctcagccataacctatatagctctaaggtgcaaattaaagtaggtatagctaaacgccaagggccaagaatgctaaatgttatgtagtgaagactgattgcaatatagctgtgagaacaggcagcttcaagtgtgacagcaacaatggaggacacttccaggtaagatggtgtcattctcagtgtgaagggctcagatgctggggctgccccttctgtccctgccttttaaatgaggcagagacttcaatttcagggttctcttgcggggccaaaacagacaagcaaagccagaggaatggcaggcagtggctctgaattaaactaaataacttattatggaaaacacgtatgatagacattccttgaggctttagagtctctaacaccagctagctctgtgattcaatcagtgttccaggattctaatttataagaggtgtgtgtgtgtgtgtgtgcatgcatgtgtgggtgtgtgagtgtaaaacacctcctggataaataactgtgacaaatctttacagaccactggcagtggggttaggatatgcccgcatgattttctgcatgagacacctgcaaagttcctgaatgtccctgacaaacccacagcctaccacagtgcatgaaacatggggactttcttttaacctagctcccatttgtcaatagcttctagtacccgtgtattgctgaattcctggcttcataattgatgttggcctttctaataatctctcagtttctgaaatgtcctcacagtgggattaatttagaaattcccctaggttttacaagtgattgtttaaaaataaattaactggagagattaatgaatgaatataagattgctaatccaattatttaagtgtttaggtgaaaggcacaaacatgcaggaatatgaaatcaagcctctgaacccacaaataacagcattttcaagcacagacatgcatattcatagtcacaaggattcagtctgccagatgtgagtcctgctcctatttcctctactctttctccgtcaaatttcttgtatcctctccctcttttcccctctttcacagcaaatacaccctgtgcagactataattgagaatttacattcttttattgctttgttttcctaggagatggttatgaataagggccagtttttacttggtctttacatatgctctatcagtcaggtacactgcatgagacacacaggcattgcagagggtttgctgaacgaatacatttcatactgaaacactgatagcaaaaacacccacttccaaactggaggctgtacactggttactttccacataggtacgctatgtgtggcttttgtgtatcaggagccatgcaaagtattctagaagctggtaggtgtcacagggagagaaagcaaattcattagttcatgggcctctacacagtacatagcagttttcagcacacaaaaaggggtaaatcaacattatttaacttattcatatatacacattttcaaagctgccaaccctaaatatattgttgtaaactaaactaaatatttcacaggaaaggaaaaataccgtttgtcataagtcaaactctaaaatagaaggatgacataacagcagtatggaattttaaaatttacattagtgactttcagagacacagggatttctttccaagactatgtaaaatgtaggaataccgctgaccaatgtaggcaatggattgtgatgcatgcctcttaaatcccagctctgcacctccgagctgtgtgaacagggacaagtaatctatccttctgagcctaaatttcctcatctgtgaaactggaagaaagattcgtacgtcacagggattttaagaaaactatcagtaagatatataaaacacctgatacatagtgggccctgaaaaagcaattattatatattctgatattgcagtaaagcaataccattttcccacaatataatttctttattagaattttgtgaattctacacaatgagaagttcatctgacacaaaaatcaaggatgcttccttctgcgatgtagcttggtagtaaaagctatttgatcaaagctaaagggaaagaatctaagattgtgatggctattcactcataggatatactattgtagtgtaggaaaactcctaacagaactactgattttcaaacttgccgcgaaataaataacctggaaaaagattgaaaagaggaaagggaagcctcatatttttccatcttgcactcccagagaatggctggccctgagcccacagtcagaaacgttctatcatggtggaaatctctctagaactggctgagttcattggtggtatgagatgttttaccatggaacagggaatgcagccatcttcctgatcacaattttgataccaaacatgcctctgtcttgttgcctttctctaatgaatcggtgaagtttagaacagcttggtgaccttggaaagcctgttctgcttctgacgaaactggcctgagcctgtgggtacacagtgtcattgataagtaaactatcttccttgtgggctggccagatgtctttgtggaggggaaggcatccttccaagaccggaatcctctcatgcagggactagcttgcataaaagaccctcctccagatccagcctcatcaagaccttgaagcagctgtaagtaccaatcattctatcccttcacaaggacttgaaacaaactccattcctctacctctgcagaaattagtgttgaattttccagcacttgaccaaaggagcaggagaacaacctctaagacgaggagcttctgaaagtattaggagatgggaggaaaatgttgcagagatgtgtgcatgagaaacggggaggggagcagagagaactccaggggcaagttaagcggtgggggtctgcctatacggccatctttgtggagtgttctcatcaatgagcctggaagattccacctcattcagatacctcctagctgtcagatactggccaagttacataaggccttagatctcaatcttctctcttttgaaaatgggaatgacaacattgtgattgaagggttttcattagggttaaataaaaaaggtacatgaagtgcctactatagcccatccattgttatgtatcctattacaaaacaatagcttccactttgttttcaacttttttgtaaatcgttctgctttgtgtttaattatataattgtgtttctttctgaaagccactgtcttgtgaaaataaaatgcaatatgtaaatcatagtatatgtcctgtccagataaaaccaaaacaatttaggcaatgaatgaccaagatctgaaaacaccaccacaagtcatgctgtgtggtaggaactgtgctaccctgtgaagatgccacggaaaatgaatcagacttctggccttcaggtatcccatggctgcctttctatggcatttggtacctatatggtgccagattctgcctatggcatctggtacctatatggtgccgaaacaaatggcaaccactggaaaagctgcagaatgcaaagagaatgttttccctataagtgtcattttcaaaagattaattaattcaacgactattcagtactgcccttctggttgtatcagagagtgtggatggtaggtttacaaagaccaacaacacatggccctttctctcacaagtctcccatctagcacaggacacaaacacattcattacatccacaggtattttctgagtgactccaatgtatgctcaccagagatgagatctgggctgcttgagatataccagtgagcaagagacaaagatccctaccatcaggagctaatactctagcaggagccattatagctggagagagaacagcaataatcatcaataagtaattaaatagtctgttagatgcaaaatactataatagaaaggacacttgggccaaggaaaagaggatctggggtatcagcgacagggtggcaaggaagagtgggtttagcagtccatcataaggtggcctgggtaggcctcatctagaaggtgagaagtgatcaaggcctcaaggtgagtgaggaagttatccttgtagacaagggacaggaacaatccaagcagagggaatggctagagcaaaggccctgaggagggaaggagcctgcctgacacaacccagaagctgcagagtccaggtccactagagatgtgtggcccatggggagtagtaggggcaactttgaggaggaaattggccagatgttgtagggcctcgtatgttttggaagcatttaacattttactctgatacataaacacagggacactagaaagggtttggtgtctgaattagaagtctccgcagtgtagagaaaagggaaaaggagggtgacagcagtgaggcaggatcaggtactgagcaaagaagtgggagaaatcaaggtgtgctgcatctttatgagagaggcggtgctcacctggacttcacatttccatggatcactgggaccacatccatgatttgtgcacatctataccattacttgcaacatcacaaaagtagcagttctgtatgcatcctgtcatttgtccgggaaaaaaaacaatgagggaggttattttgtattccattcattttgtatttaagacctttctagggaactagctagtatagacccaaaataaaaccacctttgtgtttgaacaagagtgtcctaggtacatgaaggaagaaaaaattggggaacatatgaaggttgatgtgaaagacacaacttaccccaccttccctggtcctaggttaattcatatttcatttaatttcgctattaaatagttaacaggtaaaataacaactatcctttgtgatccatgtagatcctgtcatcatttctcattcaatcaatatgctttaaatccctactggacaccagatcccaggcactgtgttgactcagaggggaacagacatgtttcaggctggttcccagtcctcaaatttctcacaagcttgcagacagatcattacagaggttcttaattagagctatgacagaattaaagtcaagaaagcctggaaaaacgggggggggtactttaatcccaatgtaaaggaagggccagcacatggtcaggaaagctttcttgggagaggtgaagttctgagtaggtaattatccctctttacacctgagaaatactaaggtcaaagatattaactcgcctaaggctgcatagctactgagagagcaggatttaaattttagttcatttgcattttaaaacaccgtatttttttctcatggactactatcaaaatcacttcccctgactctgcttccgttaagtattctgaaagtttctcaggtatgttgcagtccctcttctgatagctaggtccagctgtgagtacagtcaggctctgagaaggtctttaacattcccaatctcaggtaacagctgtttttcagagctcctctcttaggactgtacttcacttaaaactcagttacaaatgtcactttccattgctttctcactaagtaaagtagccaacttccccgaggatgcttctactattcctgtcaattgcccatctgcctgccccttcctaattctgaaaaaaaggcagagatgtgcatcctagacttgttggtttcagggtagatcctctccgctttcatcctagggattctgcaaatttacatggaagctccattctcttgggtgcctggatcttccaggcagaaaaaagctagaaaggaggaagaccataccaaaaggaatgacatgcactgtctatgtcagcaacccttaacataagggaaacatgccatagtgaatgcaagatgattacatctggactcagacagaccagggtgtggatcccagctccaccacttcccggcttgctcactttaacccatctcagcctgttaatctgttaaaggggattttgacacttttcaggtttgcttgtacaaaaatattaagtgcatataagaaagcagaccatccataaatcaacatcatggtctagtgtgatgacagcatagaatttctttttttctgtatcacttcattgcattttgtcttgcaggggaaatcaaagcctcgaatcgtgaagaaacatgtggaggtgacacaacaattatttgctgggagtgagagaggtactcacatgctcttttcacttattgtccagaagaagaacatcacgatggaaacatacctttcactggagtcattgaatcttaactactgaataccttacccaagaagtcaatgctgaatgtcatcaacaaaggccgcaacaaccatagctgtggataagaagaatccttctcttaagacatgttgattttttgagtgtgcagggtatggagacatgaagccttaaactcgaatacaaaatccactctaagtcctcattttctcttctgtaaaatggacttatgaactgcctccctccctatgagttaatgagataacagttaaatagaatgcagggcgtaacacaggacctctcacagggactgtactcaacacgttagatgtcttaacttcatccctttctgactccagggaaagtgaaatgccagcatttttaagtagatgttacatttctacagcgaacaatcttgtctttctctgattgtttttggttgatttttatgtatcatgtcaatggttggagcagctagtttttaatgcataacaaagcgctgccaaattttatgctttaaacagtaaactattttactcacaattctgcaggtcaataatttcagctggtcccatctgagtgggttttcttgtttgtttgtttgcttttttttttttttttttgctgttcatggctaggcttagttatgcatcttcagctagtgctctcttatgacctaagtagttctgcttgtgggcgaatggtctaggatggcctcacccatatgttgggcaacggtttcactgtcagctggggtgaaagggaagaatctgccacaggtatctcatcatccagctagcctggccagccttcctcacattgctgtcacaatgtttcaagagcgaaaagagagaggataccccagtgtgcaagcacctttcagttctctgctgacttctgttcacatttgttattgtcccactggacacaacaaattacatggccaagaccagaaacaatgacagtgtggaaggagatacaggcttccacgaacaaattgcagtttcactgtaacaatctactactacagtgattcctgaattacactgctcatcattggagaaatacttaaatatgcaaaaccagacagaggaatgctgttctcttaaaaaggatttttactatcgttacaaaagtcttagcttttcttgccttgttactatattatagatgaataataaagttattaggccattctcacattgctataaagaaatacctgagactgggtaatttacaaagaaaagaggtttaattggctcatggttctgcaggttttacaggaagcatggtgccaacagttgctcagcttctggggtcgcctcaggaagcttacaatggtggcagaaggcagagggggagtagatgcatcacatagcgaaagcatgagcaagacaggggaaggtgccacttgcttttaagtcaccagatcttgtgagcactcactatcacacagacagcaccaagccatgagggatccgccctcatgatccaaacatctcccaccaggccccacttccaccattggggattacaatttaacatgagatttgggcaaggacaagtatccaaactatgtcagctgtgaaagtttggggaaaaggtaattaaaaaattcccttgctattgtattaagcctgttttaagttgtgggtctccatatccagacttttccagtagggtttcagtctgtgcctctttccatgttataatgtcctattcctcttccctgccacaagtatgcccccggaagggacctattgcagaggcacggtgtgatgtagaactgatactgatggaatagactagaaaatggcacctctttcttgtgagacaaaggagacagtacctggcaattgtgaagcagccctgccctgtggccggagcctggattggcccctctcgaacccagacaccccactagtctgctagttttgctagagtgtctcgtgattcattcaaatcatgtttcaaagctctgagtagaagttcaaccattttgtactactaagtcctaaccacatttttaggaccccttagtattttatttgttttgtggtggttaatagtacactttgggaggccgaggtgggcggatcgcgaggttaggagttcaagagcagcctgaccaacatggtgaaacccgtctcttctaaagctacaaaaattagccaggcgtgatggcacccgcctgtaatcccagctactcaggaggctgaggcaggaggatcgcttgaacccaggaggcgaaggttgcagtgagctaagatcgtgccacggcactccagcctgggcgacagagcgacagagtgagactccatctcaaaaaataaaataaaataaaattgtgaaataggacgggatctccatgtgcatggtttcccaaacaccaagtggtgcttatcaaagagaaagatagagaagggtggagtgtgtggagaataggagaacgtctctgggctttaacgcaggactactagatgggtggtgctctggtctttaaggtgtactgcatcgaagtgcaaatggctgcaacacggaggcgaggagtgtacccatgaggaaactgaggtgcagggaggtcaggcaggttgtgaacaggggtttaagaaaagcgttaaattactggctgcgccaagatgctctgcaaggtgggaacctgttgaagaaataaaactgcatcatgtgactcagcaaagatgcccggctactgtgccaagaatcccgtgggttgtgcagacaacactagggcccaggtcccatgagtaagccagaatggttgatagtgggggaggatgatgacgacgctgcctttgcccctgtcttgtgtgaaacaactgcctgtgggtttcctgcagcgcagtggggagtgagaggagaaacgtcctgccgtgccacagtgagtttgggtcaaaggcacacatggaggcagtcttggccaaagtcacaatgcggtgaatttcgctgtgcgccaaggaggttcctggccccaggagtgcgaagcgcctgcgcagtgggccccaggcgttgcgcgctgcgggagccaggagacccccgcccctggcccctcgccccggttcctcgcccctcagcccacgccctcccctgcgaacgcgcacgtgaacgggagcgcggacgcgcccgagaatgcgcttcacctcgcagaagcgggtgggctctgtggagagtcgcgggctcgcgggcagcagcgcctcctccactccggcgggcccgggttcggccggccgcccatcggactggcggactggctgactgacacgcctcgcttgcccccgcctccgcccgtgccccgcccagcttcatctctccctccgctccccgggctcgggggcagacggcagacggaggcgcctctctctccccgcccctctcctcggccctttctcttcccagcacctcggctgctgcccggcagcggcagcagctgcgtcggcggcccacacagcagcgagaggcgagaggaggctgcctcgaggatgaagtgcaaacccaaccagacacggacctacgaccccgaggggttcaagaagcgggcggcgtgcctgtgcttccggagcgagcgcgaggacgaggtcctgttagtgagtagcagccggtacccggaccgctggatcgtgccgggcgggggcatggagcccgaggaggagccgggcggtgcggcggtccgagaggtgtacgaagaggcgggagtcaaggggaagttaggccggctcctgggcgtcttcgaacagaaccaggaccccaagcacagaacgtacgtgtatgtactgactgtcacggagctgctggaggattgggaagattcggttagcattgggaggaagcgagagtggttcaaagtcgaagatgccatcaaggttctccagtgccacaagcccgtgcacgccgaatatctggagaaactaaagctgggcggttccccaaccaatggaaactccatggccccatcctcgccagatagcgatccctagtatgtaccgcttgcgcccgcacagacttctgtttgtctgccttgcttaaaatgcatcccgcctggagcacctctcgtaccatgtgcggtctcatgggcaggagggaggcttttgtttccttggcagaccctctgaatcacgcttgcaaactgttgccaggccctgttttcagttggcacgtttttcagttgctttcaaaatcgcttcttggttaccctgtaaaatgtttcggagaagcctatgccgcttggggttttaggtgctgtaactgttcaccctgcttttgggcggggggggggggggtggggggcgaggggtgggcggggagtgtgtgtgtctgcctgtgcgccctgtgatgtttttggttcttttatatttcacacatattcgtgggtgcgtgcacatttttgataccagccttgtggtttgtttggtagtggaggcctttaaagtctgaccagcttggttgtgtggcatcttttagtatttttttcccttgagttgttttctccttcacagcgttcgcccttgttgtcagggaggccttctgtggtgggagttggtttaaaaaatcagttttgaattcgtaaaaacattaggaaatcctacatcttgtgctctttctgcactcgacagtcgctctagcctctgaagtggtatctcatttgcccctttcagaaatttctttttctatttctatgtaggtcatttggttttcaaaaaattttcacaagtaatttttcactgctgactttaaatcgctatttcccatgtagattaaccttactgaatagatgctgctggggatctgctagccaaacgcatctgatcagaaaaactgtattcacagaatttgatttcccatactcaacttccaactcccattgccccttactggataccatagaagaaccatggttctctggatttaagtttgtttttgaaagaaagtggtttccattccatatttgaatgtagtgacattccgcttaacctccctgactcccagtaaccacaggaatggaatcttttgtggtgattacatcccaacagagttagctctagcgatgttcagctggtacagaattgtcaaactattaggattcctgaacaatctctcaatgatagagagtaattgttttgtctcacagtaccaccttttctgggtgccaaattaaaagctctcacgtttgcctcagtacttgcttgaagtcaggaatcccatctagaatagctaaatctctcttctggaccttccgctgttcccccagccatgtctgacattaggtagaaggaaaacctattttgtgaagagggtattcgaatgaaaagatcattcctaatttctagagcaacctagactatgtcatatctcttaaacattattgacaggtattggggtcccttaacttttttttttgagatggagtcttgttctatgggtcactgttacgcactttctattaagaaattttgggtttcgctatgtaaattctaggttcctcttctggatttcatctcccatgacagttgaggaaatgtctagtttttgaagagagtatgggtgggggctgggggaccgggcgcggtggctcacgcctgtaatcccagcactttggaaggccgaggcgggcagataacgaggttaggagatcaagatcagcctggccagcatggtgaaaccccgtctctactaaaaatacaaaaactagctgggcatcgtggtgtgcgcctgtaatcccagctactcgggaggctgaggtaggagaatcgcttgatcccgggaggcggaggttgcagcgagccgagatcgtgccactgcactccagcctgggcgaccgtctcaaaaaaaaaaaaaaaaaaaaaagactgattttccccctcgtccctgtcccccaatggacaagtgcctactttttcttattctaaaaaaaatttgaagacgacatgttggagtaaaggtaagtttggttgcttgatacagaatttgctctggatggttaacatattttctaagaaacctatgttctgttgatcaggtcacctttgaaagaagtaaccctgaaaggggtgaaaggtggccataaatatttttaagtcctgtagaaaattgataaaaattgaagtgtgtatgtgtaagagcttgtaaagaaacagcaacattagagggcccttgtgggatagatggtttaaagggctctgatgctggagctgctccttgtctcacttgcctttaagtggagttcaattgtaagaaaaagcatgtcctccctccatagttgttgactgggaaaagggagattagagcttacagcactaacagctggccagagttttatttttcagagttccttttgtggaagcatcagtcaaaacaaatattctcagcatcattcttgtattgcaatcatctttctgaatgactgttggcctattagaatatggactttttgaggactaggacccagactgaatcctcccccatatcctcagagcctagaacagtgcctgaaatttggagacatttgtctttgatccacagattagaaatgtctacaagtgtattcccgatttctgagcttcataatgtacctgggacaatctgttattccctcaggctctcatctggcctcacagtgaaactgcattcgataattcactgaaggcttttccaattcaaaatggttgatgagccatagtaggtgctcaataagtatttgttgattagaggaatggatgaaccaataaaaccctattaataagaatttttctttttaggtgaatggcatagatgttgttcagatttactttgaaagaatcaagtatgtgaatggatggatgaatggaattgtgaagcacagatgagctctttcacactccaaggacacagctcatcctatgcttttggacacttcttccctgtttattacaatgactattctccaggttgttgcactaccgctgtatctgtacataattctaacttggcacctgtggccttttttgtgctcttatgtgtctgtatttcccggcagagtatacgcccttgaatgccaggaacttgtttccttagtcttttttatatatctagcatataagatattgcttagaatatggtagacatcactgaagatttgtttcagtagttcatattttgtaatgatactgaatggttaaacaatccctttctaatctgtctagcatatatgtgacttttgtttatcaagtgtcacacaactgcttcaaggcagctgtgagatactagaaagcaaaaattcttactcctatgtctgtgtcatcccagatgtgtgcctccagatggcagtatactacactatctgtaaaatatatttgcaaagccaggcacagtgttacgcgtctgcctcaggaggctgaggcagaagaatagcttgagcccaggagctttagtctagcctgagcaatataatgagactccgtctcttaaaatatttgcccaaacattgaacctaaatttgaccatgcccctagaaataattcctaatctttagaaaatagggcagagaaacattattttacaccatggagatgagatcagcagaatccagactataagaaactacaggacacatgacctagtttcttctgtaaataacttgcaaggatgaaagatggaggatgaacctatagatttaaagagacttaagagacatattaaccaattgttaattggatcttatttgaattgtgatttgaccgaactgtaaaacgaatacatttatgagacaatcggggtaatttgaacattggtggggtatttggtattagaataatggttttatcattatgttagaaagaagggtcctcatctacattctcaaacatctgtggctgatatgatatgattcttggaatttgcttcaaaataataagtctggatgttaagtgcattggaaatattgatgaaacgaaattggccttgataattgttgaagctgggtgatggctaaaatgatggttcattatatatgttcatctctatttttgtatgtttggcattttccgtaataaagtttataaaaataattactggagttattcttattaagcctaatatataaggtagaaaaaaaggaaaatatttagattgtttaaaaaaggttggctgtggcataccgcttctggcccaaggggtcaaatgcccaaaaagagaagggagaaataccctggagtggctagcagttcccttgctgtagaccaatgttagcagttttttcttttaatttggcccattgaaataggaaaagctagattcttatttattcatactagaaaataagaatggattcttatatgctgttgagcaggggttttgataacacctacataccagttcatacaaatgtgaaaaatcaaagaggtggagtctccaaggagaaagtttatggaattttataaaaatctacataagccactttttgaatagtttttaagggaacaatagctgtaaacttgttagctgcacataattaagtttaaagttatatttgaaggtaggtaaaaaaggaaattaagcagttaacattcctgacttcagtggaccattttgcatttcacagattgcagatactccttcagttctggactgtgcttaaatttctgcaaaggctaaaattctgtaaaggctgtgcttacatcaacaaacatggtgtctgtcctgatgtttttgtgagtcaagaaggaacaggcagaaagtgagaagagtattaaaggtccctcctagggaagatgaattccttcctaagtgtgaagtactgaagctgaagctgccccttctacttctgttctttaagtgtgttccaatcccaagagcaagcaactccccagaaccaactgttactgggaaaaggggaggtgaaaagtttaccttagagccctttaccagtcatagctggacagagctttcagttccaagattcccctgtgagaaggcaccatgatataccagaaaaactttcatcaagttttccctggaaattgttttctaatttgagtctactctgattgtagcagattttttttttttttgagatggagtcttgctctgtcacccaggctagagtgcagtggcacgatcttggctcactgcaagctccgcctcccgggttcacaccattctcctgcctcagcctcccaagtagctgggactacaggcgcccaccaccacgcccggctaattttttgtatttttagtagagacggggtttcacggtgttagccaggatggtctcaatctcctgacctcgtgatctgcccgtctcggcctcccaaagtgctgggattacaggcgtgagacaccgcgcccggccagcagatttttttttaagtttagaggcaagcagagccagggaagctgtagtttggtggatgtaaattaaaacaatttagtgattcggaatccaacaagctatagctcaaaactgtcttgaccagaggctgtatggcctctgccagattagtttacctctctaattttcaattttctcatctgtaaatttgcggtaattacagtccctacttttgtaaatcactgcttctgagaagcccttcttgatattttttgaaatagttcttttttcatacagatgggctcttgctctgttgccctaacaggagtgcagtggcatgatcatagctcattgcagcctcaaattcctgggctcgagagatccccctgccttagcctctagagtaactgggactacagatgtgtaccaccacacttggctattttttcagtttttgtagagatggagtctcgccatgttgcccaggctggtctcaaactctggggctctagccatctacttggcttggcctcccaaagtgctgggattacaggtgtgagctaccatgcccagccctgttttgtcatagttcttatcaaaagtatacttattagcctgaatgtctctgtcttcttaattctgaggtccactagctttgagagccagactgggttgtctctgtgtcctgagtcgggcacagagcctggaatatggcatcccacagatgttcctaacatgtttattatataaatggttgccacacctcctacttgtgaaaaacacatagctattattttgccaggtatttgtttacctgaaaatatgaaaaatgagataccgtaagactgtgatctctgatcaagtttctcttttaagtttccctttattgggaagaatatttcatctataaaccatgcctttatttttcaggattttccagtaccaatatattcctgacttcttagcttcataaaggactgtgtgatattcccttaggtgctaaattggcccacagctgcatttgataattcactgaaggcttaaagcttcccaaatacaaatgatttaagaacatggtaatccttcagtatttatttaatgtaagaacctttgaatgaacacaagtatcctaattattttaatttacaggtaaaaaacatagacagcaattaggattattaggattatatggtaacaagctcatatagacaaggctaaagcctgactgatttgactggtaaaaatacaaggaaccacttttagattgagacagtttagtacttacataaacagtacaaagaatgaaccaaagaggccaactccccaggtccttgtctcatataccctaaaagacaacaaagaaacaaaaggggctagatgactataatgcaagttgagggatactccctggctgaggagccaaatctatactgcggctgagtggctatatattccgcagctctattctaaaaggcacaggaaggaaagctccatacctcatcagaatctggtaagtgatgagaaattcattcaagacagcctctcaggagagagagggaagtgactgggagaaggccttatagcagctccttacagcctctgatcttcttgtgttctgggaggatcacaaaacaattaaccaaaactcagattagctgcagttcaagcctacatggatatatgcaagggtgccaggccatcatggaggagccattcccctacaactccactctcctttcatatatccacctaaggattctttttacaaacataagccacctgttgtggccactctaaagatacagaatggaccccatgcaaaatttggtttagatatcaagagcgataatgctgtatatacatcaacagggtattcaaaggtttattactcgcataatgaggctcttttgggagagcaaggcaggcttccaaagctgatctgaaaatgtcttgatagagctaggaaaggagactagcttacagtttttatggtggttaggggtgctggggtgagggttccaatgtgcagctggggacttgcatggtttgaaactcctttcaacaacaaaggagagagcacccaggaatttcattagcttgtccaaatgcagggcttaaggagaactgaggtgaggcttagatgctgtcagcaaacatccaaaaaaaaaaaaaagacagcttccttattacaatttactcctgatgttcgagaaataaaatgtactacgtttttgtagttgaattcaaacagatttaaataatccattatggtgctctatgaggtctgtagcctgatacctgtaagaaagatgaaagttccatcaactgtctcattctagagctcagcattgtgtattctgggaagtgaaatgaatgtcttggtggcaataaatggcatctggaactctaacggcagtaacgagtgtcttaatgaggccttgtattatagttttattatatgtaaaggcatgtatggtattgacttatattttggtatctgtgaggcaagagattcccagagttccataccccaaaaaagacactggataaggaatttctgttgctgccattgtccaaaccagacaaccatataattggcaataacctaagggtctaaatacttacagagggggtcaattagtgacccaggcatccactgctaagataatagcctgaagtttggccaattgtactgatccttgggtccagttctttatcagagacatcctaactaagggataaaaaaaaaaacagcaacaatccactgagctccattatgtgtgattatgacagtgtatccataaagtggacaaactcccattattcttcattcagttgattctacaggggtccccaagtagccaaagggtctggtagaggggtagcctcatccagcaccatggcatctggcaaaggactgaggacaggggaggccatctccacctgtaagtgtgatatgccagagggcccaggtttggttccttcctgcaacaaagagactttggtggctgtgattagtttgtagggtgctgcttccaagacccagggcataattagctggaaatggaaggtcatgagctgagtgcctatgaaagcctctatttccacaagaccccagtatgtatccagcagttgccactctaacaatatacagcataagacctacgaaggcagtttcttgcatcagaaggtcatggacaactcatggccatcatggatggtacaaggactccgagaggcattagaggaggatgctaaagcctctacagtgaagaagtctcagggtgggcatggcactaatatggttgaaaaaattctagaatattttgctgggagggggtcccactcaaggtgggcctattttgcaagtaatggcataaatgggccaaagtaaaatttgtaagtgaggaaaatgttgcctccagaacccacaaaggcctaaatatgttgggcaagctttaatgttgacaggcatggaatgccctcagtttaccaatattcaggaatttaaacaaggtggcaaggctttgtgccctgtgtggggcaatggtccatcccctttttgtgagctccttcttagaatatttgtatgtcctgaatgagttttctaaagaattctcttagaaaaggatgccatcaatgtggtgtcatatctgtgctcctggagcaagttagatgcagttaaggtcttgcctgcaaagactgtgtgagatagcagagctgttgaggtaccctctaagtagccaggtaaaggtgtaccatttcactttggaagggaaggaaaacgggctgagaggctattgaaatacacactaaacagaatgtattagccaaatatacaatagcaaaacatttatcagttgctgattggagtcaataatttccattgtaatcataattagggggtctaattactgggaccacagcataaaggctgtggtaattcatcaagaagtctcattcattctttccaagtttaggaacgggccaaattaagctgttaaatggagaagcattggatataatcaccctccctcttctctaaataggccttgtaaaatgggttgcaatcctttgaaggctctgccttgagctaagagccattgtcttgtcaatgtctaattgacactgggctctcttagctctgtacattgtgggggagtttttcatggaggcccatttcttcaagtcagtttgtaaatgccaaagactcaatctaattttgatttattatttaatgagtctgagagtccatgcccactatacaatattttagggcaatggatgctataactatggggaatttagtcaagacaacaattatgatggttaaatggaggcatacattttgtcctctattttatattcagtaactaccctaagattacagggctaccacgtgtattagggttctccagggaaacagaaccaataggatgtgtatacatatatagaagcagattataaggacttggttcatgaaattatggaggctggggtgagtcccaaatttgctatgtggactagcagccttgagacccaggagagttcatggtacagatgaagtccaaaggcagtctgttagagtattcccccttgctcagggaggtcagccattttattctattcgggccttcagttgattggctgaggcccattcatattgtggagagccatctgcttagtcaaagttcactgatttaaatattaatctcaccccaaaacaccctccaagttgacatataacattaaccatcacaagtccacccctcgtcaaattggcaaccatacacatcttaaaccatactttatcccctcaaaaagacaataacaaggccatactttctacttaacatgatacaactctcctgcatgcaatggaaagtgaataaccttttccccaggagaagatgcaaagtctttgcatttaatctctttgatagctcataagttaaatactatgataacaagttcatgcatcttgtgttacatgaaaaggagataagataaagaagaaaaagatatttgctacacacacacacacacatgcacacacgcatgcaaacacaaacatataacaaaataaggtggaaatactcatagtgattgccgtcttcatttctgtaactggtcacatagtagtagctggtatttataattaccttcttccactactgattatgtatttcctttgccttcagcaaacacctcacctggtcatagttctttatttggtagggtgacccaaaccttcattcctaaggacattagtagtcttacttcaattaggttgttgaagtttaccattgattttaattacaagacatggtaatactaagagatgccctggcggatcctcctatattgcagacatactcttccttatctcctttgaggaatagcaatctgatttccttagtagtcagaattactccagctatcagagtaagtcctttctttacttgttgattcaaagtcatgaggatcccaaagtggccaggtggcaatcttaacttccagatcaatggaataattgtatcttctggtggaagcattcctccctttgggcataagacctctaggccagcagagtataaggttgtggggaaaggaagcaaaaattttgctagtaggtcacaaggcttgtttactgagtggtgtcactcccatttcccttccttgattactggacctgtgaatcctggctattggagaaacagcaccatatattggacactgattcagtgcatatatatcctcctggagaacattcctctagccctgcaaggtattgtcacttagcatgcaatcttcaaaaggtcactccactgttctgtcaagccaggtacttcaagatgatggggaacttggtaagagcagtgaatttcatgagcgtgagctcatttcagcactgcatttgctgtgaacttagtttcttgattagaagcaatactgtatggaatgccatgacagtgaataaggcatcctttaagtccacggatggtagttttgcagaaggactgtaggtagtgaagacaaaccagtttccagagtaaatgtctattccagtaagaataaaattctgccttttcataatggaagttgctatggtttcaatgtctctccaaaattaatgttgaaacttaatccccaatgtggcagtactgagagatggggcctttaaaagacagagccctcatgaatggattaattattcattcatggattaatggattaataggttatcatgagagtgaaactggcagctttataagaaggggaagagagacctgagctccatgtgagcacactcctcagctgcctcaacatgtgttgccctgcaccaccttaggcatgtaaaaataacctctacaagagtcctcaccagcaagaaggcttgcaccatatgcaaccccttgaccttgaacttctcagcctccataactgtaagaaataaatttctttatatattaccaagtttcaggtattctgttgtaaacaacaacaaaaaatagtctaacacagaagtagtccaatgtaaccgacctgccatcaggtagacagctgatcaccctaggaaatagtgccatattggcaacttggtgttggtctctgatgctggtagtttgggcactcagcagcagctgtagccaggtcagccttggtgagtggaaatccatgttgctgagcctgtgcataacctctatccctgctgccatggccactttgttcacaagcccattgcatgatgatggagttactgggaaaaaaggctgactggtatccacagaacaggtcatcctatccacttgattatgaagatccttctatactaaggtcaccctttgtgagcattcacgtgagatgaaatatcttaacatttttcactcagagaaatctatccacatagctgtttcccaactttgcttatcaccagttttccaatcacattccctccaagtccctgaccatctgatgaaagcactggctacggcctgtgcatcaggatgtaatcccatgtctggacatttctccttccaagaaaagtgagcaaaaagttgtattccttgtagttctgcccgccgggtaattttccttcactaatgtccttcagggatgttccaggacggggacgtagcactacagctgtccatttttgggtgatgcctgcatatcacgcataatcatctgtaaaccaggtctgagccttctcttcctctgccaactaatcatagggtatttgtgtctccagggcctgcttgggcataatgttatttacacacacacacacacacacacacaaacaaacaaaccacttccacttcatggagtgctgctgtgcacacccaacttgatgacctagtggatcaaataacactcattttatgaatagcagttcaggtcccatggtaacttgggggcccatggttaattgttcagtctctactaaggcccggtagcaggccaagagctatttctcaaaaggagagcagttatatgcagagcatggcagggatcctctccaaaatcctaagggcctgcactgtgattcacctataggggcctgccaagggctctgtagtagtccattttcatgctgctgataaagacatacccaagactgggcaatttacaaaagacagaggtttattggacttacaattccatgtgactggggaggcctcaaaatcgtggtggaaggtgaaaggcacatctcacatggtggcagacaagagaagagagcttgtgaagggagacttccattttaaaaaccatcagatctcgtgagacttactcactatcatgggaacagcatgggaaagacctgtccccatgattcagttacctcctactgggtcctttccacaacacatgggaatacaagatgatatttgggtggggacacagccaaaccatatcaggctccaaacagcatctctatctgccactgtcacttcaagcaccattggatctgctggatcacatggcccaagtggcagagtagcttgcagagcagcctcgacttgttgtagaaccctgagttccacagtcaagcaaattaacatgcccatcatctcaattttgttgttgttgtaataaaggtacctaaaatctactttcttcacaaattaccagtatatgatacaatattattaactatagtcctcatgttgtacactagatgtgtagacattcatcctacataccataactttctattatttgacctacatcttctctatgttcctcttttttcattgctggaggggccagatgcaacaacttatccttcaccttagaagggatatcttgacatgttccacaccactggacccctagaaatttcactaaagaaggcccctgaatttttgtcagatttatttcacagcccctggcatattaatgtgttaccaataagtctagagtggttgctacttctcatgcactaggtccaatcagcataatatagtcaatgtaatgtaccagtgtgatttcttgtagaagagaaagatgatcaagttccccacaaactaaattatgacatagggtaggacagttgatatacccctgatgtaggacagtgaaggtatattcctggccttgacagctgaaagaaaactgcttctggtgggccttacagacaggtatgaagaaaaaggcatgtgccagatcaatagctgcatatcagatgagatgtgttaatttgctcaaacaatgaaaccacactgaaacagcagctgcaattggagtcaccacctgattaagcttatgataatccactgccattctccaaattccatctgtcttctgcacaggtaagatatttgagttgaattgggatgtggtgagaatcaccacccctgcattttttcaagtccttaatggtggcactaatctctgcaatccttccaggaacatgatattgcttttggtttactattttcctagtgtattagtccattctcatgctgcccaagcgtgaactgcccaaggctgggtaatttataaaggaaagaagtttaattgttcagttccacatggctggggaggcctcaggaaacttacaatcatggcagaaggggaagcaaacacgcccttcctcacatggtggcaggagacagaagtgccagcaggggatatgccagatgcttataaaaccatcagatcttgtgagaactatcacgagaacagcatgggggaaccacccccatgatccaatcacttcccaccaggtccctcccatgatatgtggggattatgggaactacaattcaagatgagatttgggtgggggcatagccaaaccatatcacctaggtagaggaagatctagcagcttccacttgtccttttcaaccataatagcccttactgcaaaagtcattctttgggattctgccagttgctgagtatatctacactaattattcattcttaaaatgggaaaataatcataggatggactcagggacccactgggcccactgtgaggtggacctgagctaaaactccattgttcacctgacctccatacaaccttactctgacaatgatgttttaggcctcctgaaattagtgtcagagccaatagtagtccctgaaaggtctgattattttcttttctcctatgcagagttaccctggcataaggctgtaggttcctttgggaaaggttgggagacagattaataatattcatttttggcagtgtttcagggtccttcctcaaggggatctggcctccttttcaattcaagagtttctgtgtctgtgaactggctcatatctgagaattgattgaggagctatgacactctttttatgattcaggttacacgtttattaatttgacctaaagttttctgcttatacagatcaaacataactttagtagacttctgtctttgtccactcagactgctctgataaaataccatagactgggttgttttaacaacagacatttatttttcataattctggagtcagactctttattatatgaccctatcagatgtcccaattacttgtactgattataccaaatctgttctgtttgtcttaggcaacattgaagtagagtgatcatgactataactcatagtaggatgactgaacccatctgcaggatagatttcagtcacttgtagtcaaggcagttaaatatataaaagcacagaaaagagcccaacaataacaagatgaggctaaagggaatcatatcagtgtacaaaatattaatcttattattgtttcaagtggaggctatttctggagtcagtggatgttaggaggtttctgagaattcttagattgggatttcttcttggccagaaattaagttgagaatggtgggaacatgaaattggccagatgccctgtgaacaagagctgagagagagattaatggtctcccttccaactcgtgaccattcagggtcaacggtgttttctccccaccattcatggttgttctctttccacagccacaagactgatgtgacttgtttctgcagcagtcacttcactgtttttccagtcttctcaatgtcttacccactccatatctctgacctcatccctatgtggtttggaagtttcttctttgtatttcttgtaccatctagattatctcacactccctgacatgtgggtcatgccaagatcaccttaggagtggtcatttcatatttatgatcagtaccatcaatgtccataattgcccaaatatagccagatggcaaaagaagcattaggttagtctcccacccccacagcttacaagttctagtagcttgatttcccaggagtaggtgtaggagtgaaaaagtagagtgagaggagaaaattatggtttgtattttcttactgccagcctggacttcctttcctactcttcagcctcataattaaacattttatttaaataggagttacctttctgaagaattaccacatttagagcccaaactgcctgtcttaagtgtgtgctccattgggatctgagccttggttaaccagttgtctttttcattttctcccttaagagtccactttatctttcagtggcacctgctgcctggaaatgatatggggcataaaatatccagagaatatctatatggctgcccactgtttgttactttttgctataaaggcagtaccagtgtctgaccagatgtgttcagggaatccaaatatgtaacatagtccatcttagagtcactgaatagtatggcccccatttgctaagttgataagaatagcaatgccatgcctgaaaagttgtctatgaaagtcaatgtccagtggtatcctcaagaggaggataggatgtacatattttccaggattggccaggtctggtacctctggctatgtgtcccaaagctccctttgccacttggttgtatagctttcagtctgaacacatctgccaggcttcaagtctcatgttctggaatcactaggtcttgtttttattttggcccagtcctgaattgtaaatagattactgtaccccatgtgatgttatattcaggtggatgccctacccaggtgtccttttatgggcagtacagatttgatcatcttgctgttgccattgatgttcatcttcaatgggtcctttgtcgtgggcatccctgttagtcattaacagaggttgtggtcctgtgcaatttgctgctatgttgtttgtctctgccgggactgagacttgatcatccagtcatcctactgccagttactacactgccagactcttgactcctgctcataagtcaatgaaaaatataacagggtgcattttgggggatgttttccagggaaaacaccatgaaaatatatcactaaacagacatcccttttccatgagcagttacagtacacagttttatttggagatgcaatgcagcagtggcccagcacatctcactggttttgaacttagctgatccatctgtaaaccaggcccaggtgtcctcaggaacctcagtgtactaaagcactcaagaagttgaaggtgctggcagagaccccacatctaagacagcctcatctaaaacacgaccagccaatatttcatgtaactgtgaggctccataatgccaagcttactttttcccggatatacaacttccacttaataatggaggcttgttgggtgctatagtttgaatatttttgtccccttcaaatttcatattaaaacttaatctgcaatgcaacagtattgggagatgtggcctttgggtggtgattgagtcatgagggtagagctgttataggattaggtgccattataaaagagctagatggagggagcccatcccttttttgcacttccaccttttgccacatgaagacatagggttcctccccttcagaggatgcaacacttaccagacaaccaaatatgctaccaccttgatgttggactttccagcctccagaactgtgagagaataaatttctattccttatgaattacccagtctatggtattttgttgtaacagcacaaacgaagacattgggcaacatctactttgttgatgttctcctttctgacccacctcacagtacaaatgtcggggtgtcacaacacctgctgctgctttgttagtctctcagagtccaccagcaaccaataacaaccagtaataggctgacaaatggactatgccaggtggtcatgccagccaagtgctgtgtccaaaaccccaggaagcaccattgcctagtgtattagtctgttctcatgctgctggtaaacacatacctgagattgggcaatttatgaaagaaagaggtttcaatggactcacagttccacatgactggggaggcctcataatcatggcagaagtcaaggaggagcaagtcacatcttgcatggatggcagcaggcaaaaagagaacttgttcaggggaactcctctttataaaactgtcatgtcttgtgaaatttattcactatcatggaacagcatgggaaagacttgcccccatgattcagttacctcccgtccctcccacaacacgtggaaattcaagatgagatttgggtagggacacagcgaaaccatatcacctagtgaccacattgttttgtcataagctccagtctgtgtaattgtcaattactgacacttgtagctcaaagggcttttcagaactgactggcctgagtggtaagtctgtacagattcacaggacgggtataaaattacgtagtttctttagtcacttctgcctccattagtccttggttagtatagtgacatccatttcccaccccaatatctttattgctttgaagttactacatgactagactggggaagtctggaagtctagcaggcttctggttgtacactcacactactagcactgttctaattgtgtcatttccccacagggaatatccattgcaaccatgaaatgttacaaccacttgagtgtatattggtctgaaaggacccatatgtaagattttataagttcattgtccaatctgagatttccaaatctagttaaagtaattttgaggctatgttaatttcctattgctgctacaacaaattagtacaaactcagtggctcaaaaaatatatacatttgttttattacaattctggagatcagaagcctaaaattaaggtgtttgtagggctgcatttcttctggaggcttctggggataatctatgtccttgccttttcaatcttctagaggccacctgcattccttggcttgtggcccctaactccatcttcaaagccagcagcatagtattttctctcctctctgactttctgactccctcttataagaattataatgcctcttgtgattacactgggccagcgtggataatccagcattattttcccacctcaaaatttgtaacataatcacatctactaagttccttttcccatgtaacatattcatagtttctggggattaggatgtgaacattttgagggggacagcatcattccacctgccacactagccatgactatggatgctagctagccagcatcacaatggcttgtatcccagtgttcagaagagttgaaaaggtttggcaaccttggttgctgtcaagtcagtaacacaccttgaccagtgtataaggcctccagtcccacttagagaagcagggaccttggcctctgccctagttgttcttttcttgaagcggggcaggacctgggttaagaggtagtgttgaaggtgttgggtcaacactagcttgaacagcacaaatttcatcaaggattctaggtccttttggtgctcctcctgtttgtccacagtaaacaccaaagctagctaaggattattccctcctacagccaggatctttaaattttgtggtcctcttgtggcctgatagtaagagagaacttctctcatgggaatattatcaatctcttgggggaccctggtataatagccaggtctacaaggtactattgtctggatcttcagttggtttctttttctcctccttagcctgaaggacattttcctagtcctgtgttctgtagcattttgtttcccaggagctgaggagttttctggaggctatgtctgggacacaagagaagatttttattgccgctgatagcctggtggtgccaactgaacaaaccagtgaatctgaccctgtatgactatctcatcacctaagaactcttgttctccactataaatccaggctcaggttactttagctctaagggaagttatagctgcccctgctctcacccacaggtgtttatcaaatacagaaactcatctcaggttggtcactgtttcattatgaatgtaaagacctactgcaacaattcctcactggtcttgacatactcttctatgtcaatgttattagctgaagtgtatgtggccaggctggcttggagcatggggccagtctttatatgactgagtgatttccattccttctcatttataaaaactggaatggctatctcatctgctagtcggataagccaagcccctgtactcttattggaatctgttcaaagctttctccaatttacctaatttctagctcattgtaagagtggaccacggcacatgtatgagtaactgactgcgcttgattatcagggcacgttatctgcggttatggccagggattagagggaaacagttttgctttcccaatgggacagaagggtggataataaccatggaatacttctttttggctttatggagtccctatctcttatctataactatcaatgcaagtcatcaggggtctcagggatgatggtcaaggaccacttgtccccctttattgccaaacgcttcagtaaccaggtctgcgctaccactcaccaatgttccatacctggctacccagcttgtggggtcacagctgtctttttttccaaaaaggcactgtgactttataggcctccaggaagagaggattaaaaattggaatggagtcaatctgtcagggtaaggccaaagtcccctatagtgtggcctcttttattatatacaaatggccaaattttgtaggagttatagtttttctatcaggaacatactgttatttagcttgcaaaacacagcagtttttctatgatgccagagggattcagtgttgtgaagctacctacattgtttcaagaaattttatttgaaaagcaggccttgaattttgggggagcttatcagtttttcccgtagctgggcagccaagcctgctgataatgaaacctttgtcaaccaacaagacatcatttatacagtgaaaactttggacatcagaggaatttcctaacaccgtataaacattcaagattcaagtatgtaacctattttaaaccaattacacatttttacaactatatacacaatggatcttctcaagcctcactcaagttactttttttctgtctccatagcaagttttgcccaaactctactaggcatcttttttttcacagaaacatagaacaagaggcacctccagagttacagggtagctggaagctcagagaataggggaatagggtggcacagggtgagcaacttacaccagtaagtgcatctttgcacttacttttttgtggttgtaaatggccattcactgggcttcaacaaatgtactcttaataacatcaaagcatcaattgaacagctggtttcaatcttacttctagccacttgacttccaaatgtttatcagcaggtaacatggtaacactatgggatccctgggagtcctgtcccttaacagggctcatacagaccctgtgcgaggacccttacttctcctccctcacctacctcttaggcaagggctatgttaccagatcctgggagtcttatccttcctaatatggcctatgtaatcccttaataggaggaccctccttcaccttttgcccaccacataggcaaaagcatgtgcaaccagatgccaaggaatttatcttttcacttaaccaggactgtgcagctccatgttttctaaaaggacactataaatttactggcttcacattgacacaaaatttgtcaggctcacaagtaataataaggcaaagccaaggcctgactgatttgactagtaaaaattcaacaagctgcttttagatttaggcagtttagtacttacatagacagtgaaagaaagattagccaaaggtgccagatccctgtgatccttgtctcacacaccaaaaaggatgacaccaaaagggactaggagactacaacacaacttgtacagtactttgttactgaggagctaaatctagatagcagttaagtgattctatatcttgcagccctattttgaagaggatgggacagaaagcctattacctcctcagaaccaggaagtagatgggaaactgtctcatgacagcctcccggggaactaggaaggtaagagatcgccttacagcagcttcttataggcttcccattctcttgtgttccaggaggatcataaggcactcttctaaaacccaggttaggtgtggttcaagcctttgccaatgtggatacaaacaaggcacaagggcaccatgacagaaccattccctttgggtgaaaaccatagatgtgaacccagtgatccatagaattactaagtctgtttaggcctttcacatttataatgagggatatctcattttcctcctcctcatttagccattcattctcaatctactttgctgtctcttctatttttcccctccctgctcaacattttactctacacaaacttcaaattgagaacctatactcctttagtgtacttttgtttgtgtttgctccctgtctagattctgaaatgtttgtggggaaatattccatttcattgccttttctatatccagtagatatcacactgaatgaaatatggtaggctatttgttgaattaaaattaattttagcattgacactaattggaaaaagatcccatccaatctggaattagtagatgatttttctgtatgtgctgtatgtgtcttgtttgtgattttagtgcatcaagtgctatataaattctgttaggcaagtgagggatttgaggactagaaattggactcaattttctgtgtctgtcctcacagtgactagctcagttctcaatacaaaatatgttaagcatcatttctatcactttagtaactcatgtcttccctacggtttttgtctcatctacacatggcctgtacttaatatttttaaaattaaattaactccaaaaatgaatcctctgggtactgaacaatattattaaataaaaataaatttaaatgttaatatatccaaagatactcccatcctcagaatcccctcccagaatataccctccatccctatcgatgcttcaagggttcacccaccagttccaggggttggtatttccagtcacagaacctccttaggagatgcgatgactctgagttagggccaccatagaaaccagagaaagaactgttcctgaagctagagaaaaggaaagtacttacaatctgaacccaaaggaatcttgtacttcccatatcatgatctcagaacttgtttgagccagtgaggcagagcagatggcagaccagaaagaaaaaaaaatgagctcaccttggcttattctccttgaaggggaagatattctagcttcatgcctctgaggttctaggagagatcacagccccacagccactcctagaaaaagaggcacctgcatatcaaacaactctgaagaaaatctgccaaattccaaacttcccctctcccacacattccccagagaaactccccaacaaggccctcaataataaagtggtaacaccaagaggatatatgtcaaaagaaatatagatccaagattattttctaggttttaagaaaggcaatagcaacaaaatccaaaatagacaaatgggatctaattaaactaaagagcttctgcacagcaaaagaaactatcatcagagtgaacaggcaacctacagaatgggagaaaatttttgcaatctacccatctgacaaagggctaatattcagaatctacaaagaacttaaacaaatttacaagaaaaaaacaaccccatcaaaaagtgggtgaaggatatgaacagacacttctcaaaagaagacatttatgcagccagcagacatatgaaaaaatgctcatcttcactggtcatcagaaaaatgcaaatcaaaaccacagtaagataccatctcacaccagttacaatggcgatcatcaaaaagtcaggaaacaacagatgctggagaggatgtggagaaataggaatgcttttacactgttggtgggagtgtaaattagttcaaccattgtggaagacagtgtggcgattcctcaaggatctagaacttgaaataccatttgacccagcaatcccattactgggtatatacccaaaggattataaatcatgctactataaagacacatgtacacatatgttttttgtggcactattcacaatagcaaagacttggaaccaacccgaatgtccatcaatgaaagactggattaagaaaatgtggcacatatacaccatggaatattatgcagccataaaaaaggatgatttcatgtcctttgcagggacatggatgaagctgtaaaccatcattctaagcaaactatcagaaggacagaaaaccaaacactgcatgttctcactcataagtgggagttgaacaatgagaacacatggacacagggcagggaacatcacacaccagggcctgtcggggggtggggggctaggggagggatagcagtaggagaaatatctaatgtaaataatgagttgatgggtgcagcaaaccaacatggcacatgtatacctatgtaaaaaacctgcacgttgtgcacatgtaccctagaacttaaagtataataataataataataaatggtctctaaaaacattaacaggaggaggactggagaccatgagaaagaagaaaacttaggggtagaacatgaatcagataatagagaccttttctttatttgtcttttataaatatgaaaatagggctcatcaatctaaaataatcaaaaacatgagaatctagtttaaagagagttttattcatgagcaaaagttgaggacaggctgcccaggaaagcacaagctccaaagaatggaagtcagtattccaaagtgtagaagtttgggatcgtttatataaacaaagttcaggaaagtttcacagaatttcagtatctttctatgtaaagcttaaggcacagttacaatgatctgattagttaaggaggtccttttatttcatgaaaggtatatttaacattccacagtgaagatgaaactgtcatggggttcctattcaggtgccatcttgtctgagttaggtacaggacaataaaggaagcagttaatctgtaataaagttcagtgattggagggggaggtcttgtctctggtctttcctagtcatttacagaacaataacaatgaggacaagagttaagctataatctgtgaagtagagttataatcatgctatgtgactcagattacagtcacatctcgctcaaggcttaaaatgttttgagggttccaatggcttttttaaaattccaatggcttttaaatctgattcatttttcacatttccccctttttaatcaatatctttcaaagattagaaggagcaagattatgtgaaaaaaaaagatatttcaaagaaagcatcatagatgagcaaaacaatagctttgcctccttttatgttcaggagtatagtcccatgtcactaggaaggttctttcctagaatgtcatgtgccatggcaaagggaaattggacaagccataaagttgatggagtataggccaaatttaaagaaacatgaaaaaagtgattttgtgacctgtgttaggctaaacagatatatcttcaattaatgcagttctttgggcaatcattattctaatctttttagtcatgcattgactccattgcaaacaaatgccataacagcagtgtagacaaaaacaggacaaaacacaacatatgattataattcccaggataaataacagattttgccaccaaattccccaaaatccaaacaagctgcttagccaattgcttggagagggttttggatctgaaaggttggttagttgggttttcatgccatcgtttaatttagtgatgttatttgattcatctgggatatagatacaacgttcagtttttatgatagtgcaggttcccccttgggcagcactgaatatgcttaaagccatagagttctataatataccatttctcacaagagtaatttcattatttaataacaaaatacccatgcagctatcatttagtgctttttgtgtataattggttagggtctctacatggcaaaatgacatgctcaatacctagttgtggtgtgaagatggaagctaaatggtcataccaataggacacaacaaatccaacaagattgtaaatgaggaaaatttgaaggttttgacaaggtatgaactacttaaccttgcacccaaccataaccaagggaacattgtcctaaccttcctgggggtaaccatggccataggttagtgccacatagccaagacattctatttggagctaactaataaatacatggtcattgtgcctattcagtgttacgtcaatcagtactttttaacataatgttgtcgatacaatattctttgggtatccattccatatctctagtgctactgggccaggtgtctttagtatgatttctctgttcccaacataaagggtcaggctggctgagctgaccaaaggaggggttaaaccagataaaaccatcccaaatttgttataccatcctgaaatagtattgtcttaggttttaagtggggcagtgttactgtttcatacatcagttggggtagtggcagcgttaaagctaatgaactaaattttttactgagaagcttttcccatgccctttttctgcaaagtactaacaggccaatgatgaacattgttcttaattacactagtgtcaagcaccaatgactggttttgagaaagatggatatatttctgacgttttatccactcttgtccgaagggaggagatactcaccacagaaggctagaaatactggaaaggggcatgagactacacacccgtcaagcacctttttgttatctattacataatcctgggctcattgcagaaagagatttgcttcataagcaacagctggtgatagtagtgccaacatgggagaaacaaggacaaaaggaaagaagtttagtgggagtttgtaaaggaagatgttccccatctattaataattgtatattaagtattcatttagatagaggcctaacccagagtcttgtgttttagctgtctaaatcagatgtcatctcttcttgaactggcatcaacttattttaagttggaggtcactttctgggaaaacagtctactcaggagatggaacattctttagaagagaaatgtggatctttgtgtctattccttctaatttaacagcacaagggttactaagaagcacttggtaaggggccctccattttggttggaaagagtcttttcaaagatgctggggagggggcggggccaagattgcctactagaagcagtgtgttctgaggctcccatggaaaacaacaacaacaacaaaaacaaacaaacaaacaaaacacataataagcatgtgaatcctttaccggcaaccaaggtatccaggttctatcatcaaaactgactagaaggctggtgtgacccacggagaaggaagatcaatgtggtgcagcggcccacctgagagccacaagagccacacagggaaggggatccccctccccgcagccaagagaggtggtaggtgagcgtgctacccagccggggaaaccgtacttttcccaagtaactgtgcaacccatggatcggaatatcccactcatgaatccatgccaccagggcctagcatcccaaccccagaacacacacattcttacagcctctcagctagaatctgcttaagcctacggaactcctggggggaggggcgacgagcactggctgctgctgcctgctatctaagccctttgagctctttgggggtggggcagcagccatcagtgggactcgcaactgcctaacatactaagctccctgggcaggggaagggcagcacccatctctgtagccccaggctgagcttttcccctgctggagccagggaggctggatggcttagtcccaagacttgtcccccacagcccaacacacaggctgtggtagtctgaggccagaggacctcttcaggcctgaatctgacccatccttcctcattgggtgtggcttccctgcaggaactccaataactctagtcagaggctcagggacagaacccagatctccctgggcctaagtccctagggggagaggtaggcccagtctctgtggaccaacagacttagcctttcctcctggtagttctgaggaatatgggcagcccagatgagtggattttcccccagtgaggcacacccccctccaccaaaggacaaagtgcttcattacatgggtcctgtcccccatgccacccaactgggtgagaccctccaacgaggttgtcagacaccctatacaggagtgatcctaccggcatcaggttggtgccccttgaggtcagaggtcccagaaaaagaagcaggcacccatgccatctgtgctgttctccagcctccttgagtgacatctccaggtgtgggagtgaatcagatgaatagggcctgaactgaacccccagcaaacggcagcagccctacagaagagggacctgaccattgaccgaaaaacaaacaagtggaaagcaacaacaacagcatcgacaacagcaacaaaaagcccccataaaaaccccatccaagggtcagagcaaagagcaaagctagacaaactcatgaacatgagaaagaatcagtgaaaaactgctgaaagcccaaaaggccagagtgccttttctcttccaagtggtctcaatatctgtccatcaagggcacagaactggacagaggatcagatggacgaattgacagaagtaggctttagaagatgggtaacaaaaaacaaagatgagctaaaggaacatgttctaacccaatgcagagaagctaagaacattggtaaaaggttagaggaataggctgggcacggtggctcacgcttgtaagcccagcactctgggaggtcgaggcgggcggatcacgaggtcaggagatcaagaccatcctggctaacacagtgaaaccccgtctccactaaaaatacaaaaaaaaaaaaaaactagctgggcatggtgacaggcacctgtagtcccagctactcaggaggctgaggcaggagaatggcgtgaacctgggaggcggagcttgcagtgagccgagatcgcgccaccccactccagcctgggtgagagcgagactccatctaaaaaaaaataaaaggttagaggaattgctaactataataaccagtttagagaggaagataaacgacctgatggagctgaaaaacacagcatgagaacttcgggaagcatacacaagtattaacagctgaatcaacagagtggaagaaaggatataagagtgtgaagaccaccttactgaaataagccatgcagacaagacttgagaaaaaaaaaatgaaaaggaatgaacaaagcctccaggaaatataggacttcataaaacaccaaacctacaattgattggagtaccagaaacagacagggagaatgtaaacaagctggaaaatacacttcaagatactatccagaacttccccaacctagcaagacaggccaacatgcaaattcaggaaatacagagaacaccattaagatactcaacaagaagatcaacccaagacaaataatcatcagattctccaaggttgaaatgaagaaaaaaatgttaagggcagcgagagagaaagaccaggtcacctacaaaggaaagcccatcagactaacagcagaactctcaccagaaactctacaagccagaagagactgggggccaatattcaacactcttaaagaaaagaatttccgacccagaatctcatatccagccaagctaagctttgtaagcaaaggagaagtaaaatcctttccagacaagcaaatgctgatggatattgttactaccaggcctgccctgcaaaagctcctgaaaggagcactaaatattgaaaggaaacacctgtaccagccactgcaaaaacataccaaaatataaagaccaatgacactacaaagaaactgcatcaactaggtgtgcaaaataaccatacagcatcatgatgacaggatcaaattcacacataagaatactaactttaaatgtaaatgggttaaatgccacaattaaaatacacagactgaaaaattggatatgcagtcaagacccatgggtgtgctatattcaggagacccatcttacatgcaaagacacacacaggctcaaaataaagggatggaggaaaatttaccaagtaaatggaaagcaaaaaaagaaaaagcaggggttgcagtcctagtctctgacaaaacagactttaaaccagcaaagatcaaaaaagacaaagaacagcattacataatggtaaagggaacaattcaacaagaagagctaactattctcaatatatatgcacccaacacaggagcacccagattcataaaacaagttcttggagaccaacaaagagactaggaatcccacacaataatagtgggagactttgacaccccactgtcagtattagacagatcaacaagacagaaaattaacaaggatattcaggacttgaactcagctctggatcaagtggacctagtagatgtctacagaaatctccaccccaaatcagtagattgtacattattctcagtgccacatggcacttattctaaaatcacccacataattggaagaaaaacactcctcagcaaatgcaaaagaacggaaatcataacaaacagtctctcagaccacagtgcaatcaaattagaactcaggattaagaaactcactcaaaatcacacaatttcatggagattgaacaacctgctcctgaatgactcctgggtaaataataaaattaaggcaaaaatcaagaagttctttgaaaccaatgagaacaaagagacaatgtaccagaatctctggggcacagctaaagcagtgttaagagggaaatttatagcactaaatgcccatatcagaaagctagaaagatctcaaatcagcaccctaacatcacaattaaaagagctagagaggcaagagcaaactaatccaaaagctagcagaagacaagaaataactaagagcagagaagaattgaaggaaacagacacacaaaaaaccctccaaaaaaaaattcaatgaatccaggagctggttttctgaaaaaattaacaaaatagatagaccactagctagactaataagaagagagagaagaatcaaatagatacattaaaaaatgattaaggggatatcaccactgaccccacagaaatataaactaccatcagagaatactataaacacttctacacaaataaactagaaaatctagaagaaatggataaattcctggatgcatacaccctactgagactaaaccaagaagaagctgaatccctgtatagaccaataacaagctctgaaactgaggcagtaattaataacctaccaacctgaaaaaaaaaaaagcccaggactagatagacggattcacagctgaattctaccagaaatacataaaggtgctggtaccattccttctgaaattattccaaacaattgaaaaggagggactcctccctaactcattttatgaagccagcttcatcctgatacaaaaactgggaagagacaacaaaaaatgaaaacttcaggtcaatatccctgatgaacattgatgtgaaaatactcaataaaacactggcaaactgaatccagcagcacatcaaaaagcttatccaccacgatcaagtcagctttacccctgggatgcaaggctggttcaacatatgcaaatcaataaacataatccatcacacaaatagaaccaaagagaaaaactacatgattatctcaatagatgtagaaaaggcctttgataaaagtcgacattccttcatgttaaaaactctcagtaaactaggtactgatggaacatatctcaaaataataagagccatttatgacaagtcacagccaatatcatattgaatgggcaaaagctggaagcattccctttgaaaactggtacaagacaaggatgccatctctcaccactcctattccacactatattgcaagttctggcaagggcaatcaggcaagagaaagaaataaagggtattcaaataggaagagaggaagtcaagatgtttctgtttccagatgaatttatattatatatatatataatataaaatccaaatgattttatattaataaaacccaatcatcttggcccaaaaacttcttgaactgataagcaacttgagcaaagtcacaggatacaaaatcaatgtggaaaaatcacaagccttcctttataccaacaataggcaagcagagcgccaaatcatgaatgaactctgattcacaatcactacaaagagaataaaatacctaagaatacagctaacaagggatgtgaaggacctcttcaaggagaactacaaaccactgctcaaggaaataagagagaacacaaacaaatgggaaaacattccatcctcatggacaggaagaatcaatatcgtgaaaatggccatacagcccaaagtaatttacagattcagtgttattcccaaactaccattgacattcttcacaggattagaaaaaactattttaaatttcatatcaaatcaaagaagaccctgtatagacaagacaatcctaagcaaaaagaacaaagctggagacatcacgctgcctgacttcaaactatactacaaggctatggaaaccaaaatggcatggtactggtatcaaaacagacatatagaccaatggagcagaacagagacctcagaaataataccacacatctacaaccatctgatcttcaacaaacctgacaaaaacaagcaatggggaaaggatgtcctattcagtaaatggtgctgggaaaactggctagccatatgcagaaaactgaacctggaccccttccttacaccttattcaaaaattaactcaagatggatttagacttaaatgtaaaacccaaaaccataaaaaccctagaagaaaacctaggcaatgtcattcaggacataggcgtgtgcaaagacttcatgacaaaaacaccaaaagcaatggcaacaaaagccaaatttgaaaatgggatttaattaaactaaagagctgctgcacagcaaaagaaattatcatcagagtgaacaggcaacctacagaatgagaaaattttggcagtctaccgatctgacaaagttctaatagccagaatttacaaggaacttaaacatattagcaagaaaaaaacaaccccatcaaaaagtgagcaaatgatatgaacagacacttctcaaaagaagacatttacgtggccaagaaacatatgaaaaaaagctcaacttcactgatcatcagagaaatgcaaatcaaaaccacaatgacataccatctcacgccagtcagaatggcaattattaaaaagtcaagaaacaatagatgctgcaaggctgtggagaaattggaacgcttttacactgttggtgggaatgtaaattagttcaaccattgtggaagacagtatggcaattcctcaagggtctagaaccggaaataccatttgacccaacaatcccattaatgggtatatatccaaaggaataaaaatcattctactataaagtcacatgcacacgtatgtttattgcagcactatttacaatagcaaagacatggaaccaacccaaatgcccatcaatgatagactaaagaaaatgtggtacacatacaccatggaatactctgcagccataaaaaggaatgagatcatatcttttgcagggacatggatgaagctggaagccatcatcctcagcaaactaactcagtaacagaaaacgaaacagcatatgttctcgcttataagtgggacttgaacattgagaacatacggacacagacaggggacacacgagggcctgctggggggcagggggcaaagggagggaatttagaggacgggtcaactggtgcagcaaaccaccatggcacacatatacctttgtaacaaatctgcatgttctgcacatgtatccctttttttttttagaagtaattaaaaaaaatgctggggagaaggtggagcaagatggctggatagaaagctgcctgattgctcccccaccttacccaccaccaccagcaaggacacaaggctaacaactatttacacaggaaaaaaaaaaaaaaaccaccttcataagaatcgaaaatcaggtgagtacatatagtaccttgttttaacttcgtatcactgaaagaggcactgaagagatagaaaaagcagtcctgaatcgccaacactacccctcccctaccccagcaatgacagagtggtgcagagcttctctgggtgctggaagagaaacaacacaacagttttgaggcattgaattcagtactgtcctgttacagcagaatggaaaattagaccaaatagagctgatgcttctccacggagggagcatttaagccagccctagccagaggggaatcacccattccagaagtctgaacttgaatgcctacagacctcaccaccaagggctacaccactctgtgtctccaagtaaatgtgacaagcactctaggccataaggagtgaaactcttaggggagaggccagtcctagggctgaactagggtcaaaaacagtggactagtcagtaggggtggggggactcgacctactgagacacgaggagttagggcagccaagaagtgctgatatcatccctcccctacccccaagatgcacagtcatggctacaaaacagactcctttcttcattcgagaagaggagagggaagcgtgggtaggactttgtcttacatctgggataccagctcagccacagcagtaaagggcaccagtcagagctgtgaggcccccattgcagaccctagctcctggagaacatttatagacataacctgggccagtaaagaacccactgccttgaagaaaaggacccagtcctggcagcattcatcacctactaactgaagagaccttgggccatgaataaccagtagtgatacccaggtaccacatcaaaggccttgggtgagcctctgacatctgctggctccaggtaccagcacagccacagtggggtagagcaccaagtcggctcttgatgtccctgattccaggacttgatgcttaaatggcatttctggacctgccctgagccagaatgtagctcacttccctgaagggtgagttccaggccaggcagcattcacaacatgctgacttacaagaccacgggccttagggggacatcagtggtagtctggcagtactcctcatggccgggggtggtggtggctacagggtaaggctcctctgagggaagaaagggaagaattgcgtcttgcggttgaagtgccagctcagctgcaatataatagaataccaggtagatgtctaaggtttttgactctagtctctgactccctgacatcacttatggaccctcccaaagcctgggggacttttatgtcctgaagggaaggacacaccacacgcctggctggctttgctacctgctgattgtagagccccagggccttgaatgaacagaggcagtagtcagggagtggttacagcaggccttgagcaagacccagaactttgctggcttcaggtctcacccagtacagtcctagtggtagtagtggccacagggtgcctgggtcactccacccccagctttaagtggcacagaacagacagagagagactctgtatgtttgggagaaattaacagaagagaataggagtctctgcctggtaatccagagaattcacttggatcttgtgcaaaaccatcaaagtgatacttctatgagtctgtaagaaccacagtgttattgggcttggcatgccccactaaagcagatacaggttagatcacaatcccaagtcctttcaaatatctagaaagccttcccaagaaggatggctacaaataagcccagacggtgaagactatgataaatacctactcttcaatgcccagacactgaagaacctttattttactagcatcaacaccatccaggaaaacatgatctcaccaaacgaactaaataaggcaccagggaccagtcctagagaaaaagagatatgtgacgtttcaggaagataattcaaaatggctgtttggaggaaacttcgagaaattcagataacacaaagaattaattcagaattctatctgatacatttgacaaagacattgaaataattaaaaagaagcagaaattctggagctgaaaaaaatgccattgtcatactgaaaaatgcattataatcctttaacagaatggatcaagcagaagaaagaattaatgagcttgaagataggctgtttgaaaatacatagaggagacaaaagaaaaaagaataaaaaacaatgaagcatgcctacaaaatctagaaaatagcatcaaaagggaaaatctaagagatattggccctacagaagaggtagagaaataggggtagaaagtttattcaaagagattaaacttcccaaacctagggaaacatatcaatatccaagtacaagaaggttatagaacaccaagcagatgtaacccaaagaagactaccttaaggcatttaacaatcaaaatcccaaaggtcaaggaaaaaagaaagaatcgtaaaagaagcaagagaaaggaaacaagtaacatacaacagagctcaaatacatctgacagcagacttttcagtggaaaccttataggccaggagagagtgacatgccatatttaaagcgctgaagaaaaaaatattttaccctagaatagtatatctgacaaaaatatctttgaaacatgaaggagaaataaagaatttcctggacaaacaaaagctgagggatttcatgaacatcagacatgtcctataagaaatgctaaagcaaggacttgaatcagaaagaaaagaatattaatgagcaataatcacctgaagctacaaaactcattggtaacagtaagtacacagaaaaacacagaatattataacattgtaactatggtgtgtaaactactcttatcccaagtagaaagactaaacaataaaccaattaaaataactacaacaaagtttttcaagacataggaagtacaataagatataaatagaaacagcaaaaagttaaacagcagaggaacaaagttaaggtgtaaagttttattagtttatgtttgattgtttatgcaaatagtgttaagtttttatcaggttaaaataatgggttataagatagtatttgcaagcctcatggtaatctcaaaccaaaaaacatacaatggatacaccaaaaataaaaagcaagaaactaaatcgtatcaccagagaaaatcaccttcactagaggaagacaggaaggaaagaaggaagaaaaggccagaaaacaaatatcaaaatggcagacgtctttacttatcaataataacattgaatataaatggactaaactctcacatcaaaagacatagactggttgaatggatgaaaaacaagacccattgatctgttatcctcaaaaaacatacttcacctataaaaacacatatagactgaaaataaagggagagaaaaagatattccatgccaatggaaaacaagagcaggaatagctatatttatatcaggcaaaatagatttcaagacaaaaactattagaaaagacaaagaaggtcagcgtgtaatgataaaggggtcagttcagctagagaatatgacagtcttaaatatatatgcccccaacactggagcatccagatatataaaggaaaatctattagagctaaagagagagttcagccccaatgtaatcatagctggagtcttcagcaccccactttcagcattaaacagatcttccagacagaaaatcaacaaagaaacatcagacttaatctgcactatagaccaaatgtatacaatatatatttacaagacattttatccaagagctgcagatctaatatatatttatagaacatttcatccaagagctggggaatacaccttcttttcctcagaacatggaatattctcaagaatgagccatatgataggtcacaaaacaagtcttaaaacattcaaaaaattgaaaaatatcaagcatcttaccacaattgaataaaactagaaattaataatagagaaattttggaaactatacaaatacatggaaattaaacaatatgctcctcaatgactaatgggtcaataaagaaattaagaaggaaattgaaaaatatctggaaacaaatgttaatggaaatacaacataccaaaacctatgggatacagcaaaagcagtagaaaagggaagttcatagctataagggccacatcaaaaaagaagaaaaccttcaaatgagaaaacgatacatcttagaaaatctagaaagccagagcaaaccaagcccaaaattaatggaagaaaataaatcaaaaggtctgagcagcaataaatgaaattgaaatgaagaaaacaagacaaaagatcaatgaaacaaaagttggttttctggaaagttaaacaaaattagcaaatctttagccagacaaagaaagaaagaatatactaataaataaaatgaaaaatgaaaaagaagacattataactgatactacagaaattaaaggatcattagtggctactatgaacaactatataccaataaattggaaaatctagaagaaatggacaaattcctagatacatacaacctaccaagattgaaccaggaaaaaatccaaaacctgaacagacaaataacaagtaatgagatcaaagctgtaataaaaagtctcccagaaaagaaaaatccaggagctgctggcttgactgctgaatccaacattaatacaaatcctacttaaacttttctggaaaatagaagatgaaggaacacttccaaactcattccacgaagccagtattaccctgataccaaaaccagacaaagacacatcaaaaaaagaaaactacaggacatcatctctgaggaatattgatgcaaaaatctcaacaaaatactagcaaactgaattcaacaaacattagaaagatcattcatcatgatcaagtgggatttattcctgggacgcaaggatggttcaacatatgcaaatcaatcagtgcgatccatcatatcaacagaatgaaggacaaaaaccatatgatcatttcaattgatgctgaaaaagcatttgataaaatccagcatcccttcatgataaaaacccttaaaaaactggttatagaaggaacatatatcaacatagtaaaagccatatatgaaagacccacagctagtatcatactgaatgaggaaaaactgaaagcctttcctctaagatctggaacacaacaaggatgctcagtgtcactgctgttattcagcatagtactggaagtcctacctagagcaatcagacaagagaaataaagggcacatggttgaaaagaaaaaaaaaatcaaattatctttgtttacagattatatgagcttatatttggaaatacctaaatactccacaagaaaactattagaactgataaacaaattcagtaaagttgtaggatacaatatcaacatgcaaaatcagtagcatttccatatgcccatagccacaatagccacacataaaattaaaaagctaggaattaaacagagaaaagaaagatctctttaaagaaaagtataaaacactgatgaaagaaattgaagaaatcaccagaaaatggaaaaatatttcatgttcatagattggaaaaatcaatattgttattggaagaattaatattgtccatgccactaaagcaatctacagactcaatgcaatccctaccaaactacccatgacattcttcacaggaatagaaagagcattcctaaaatttatgtggaaccataaaagacccagaatagccaaagctatcctaagcaaaaagaacaaaactggaggaagcacattaccttacttcaaattatactacagagatacagtaaccaaaaaagcatggtactagcataaagacagacacatagaccaatggaacagaatagagaacccagaaacaagtccacacacctacaatgaactcagttttgataaaggtgtcaagaacatacactggggaaaacacagtctcttcaataaatggttctgggaaaactggatatccatatgcacaagaatgaaactagaccctatctctctctctctccatatacaaaaatcaagttaagatggattgaagacttaaatctaagacctgaaactgtgaaactactacaagaaaacattgggaaaaatctccaagatattggtctgggcaaaaatttcttgaacaataccccacaagcacaggcaactaaagcaaaaatggacaaataggatcacatcaagttaaaaagcttctgcacatcaaatgatacaatcaacaatgttaaaagacaacctgccgagtgggagaaaatatttgcaaactacccatctcacaagggattactaaccagaacatataatgagctcaaacaactctaatggaaaaaaaaaactaataatcctatcataaaatggggaaaagatttgaatagacacttctcaaaagacatacaaatggcaaacaggcatatgaaaaggtgcccaacatcactgatcatcagagaactgcgaatcaaaacgacaatcagatatcatctcaccacagttacaatgacttatatacaaaagacaggcaataacaaaagctggcaaggatgtggagaaaagggaacctttgtacactgttggtgggaatgtaaattagtacaaccactatggacaatggtttggaggtacctcaaaaacaaaaattgaggtaccatatgatccagcaatcccactgctggtatatacccaaaagaaaggaaatcagtatatggaagagatacctgcactcctatatttgttgcagcactttacaattgctaagatttggaagcaacccaagtgttcgtcaacagatgaatggataaagatgtggtacatatactcaatggagtaatattcagccataaaaaagaatgagatccagtgatttgcaataacctggatagaactggagatcattgtgataaattaaataagccagacccagaaagaccaacatcacatgttctcacttatttgtgggatctaaaaatcaaaacaattgaactcatggagatagacagtagaaggatggttactggaggccgggaagggtagtgagggtatgggggtggggatggtttatgggtacaaaaaatagaaagaaagtagaagacctactatttgatagcacaatagggtgactatagtcaatattaattgtacattttaaaatcttaaagagtatacttggatagtttgttactcaaaggataaatgcttgaggggatggataccccattctccatgatgtgcttattgtatattgcatgtctggatcaaaacatctcaggtaccccataagtatgtatatctactatgtacccacaaaatttttttaaaaagatgccatttccagtagacaaaatctcctggttaaaaattgtgggtcttgaattctttatttcctaggagcccactataaaaataatctttcactagattataattttttagttaattaataaggttagaacaataaatatgtctccccttgcaattatggagttacaatgtcctggggtagactcataggtcttccagttgttatttcaaatagggataactgttgttttccaaaaggggctgatcttaggttaagcaaaaccaaggaaagtgcattcagccatggaatcttaagaacttctgttatttttgccaattgagtcttaattattccatttgtacattccaccagtccagatggttggaaatgatatgcacaataaaagtgcttgaggatgggtcaaattttacatattgattgaattatctgtccagtgaagtgagtgcctctgttgctctgaaattccataggaactccccacgttggaataattttttctaagagaattttacttgctactaagtccatttcttttctgaatggaaaatgcttctattcaacaagaaaacatgcaaatcatcagtagaacagaattgtatccttgtgatagtggcagctaaataaaatttcattgccatacttcaaaggggcctacaaataaaggaaaatgtccttgggaactgtgtaaaagttttcctggattctattttgggcagatatggcagcgattgtatgcctcatgacctatagtcagagaaagtttccaaaaatattattttccacaagcaaccactttatcagggctccaatgagtgaaatcacgtacataggtaaaaatgatgaccacaattcagcaggaagtataggcaagttttttgacccctaccgtatctaatctttgggagagtatgttcctccttttgttttccaactttcctgtttggattttggagctctagatttagttcattttatgtcaaattcaggtgcttttaaaaaaagttattctcttttttggggtgcttattttaaagttaatataaattgcttttcttgtttagatgcatttagagcatctcttagtgttaccttatcagctagctgatttcctttgctttctggagtatctgatttggaatgacctagaattttaataatggccagtgatttgggtaataatatggcttctaatcattgtgaaataagatatcaattttttatgggctgactagaagttaaaaatcctctttgcttccatagcattccaaaattattagctactctaaaagaatatctgctgtttgtatgaatattagcattttttttcaccaattgacaggccctgattaatgctatcaattctacttgttgagctgaggtggcttctggaagggaagcactttccatttcttcagttaaatatactcctgtatagcctgcacagtaagtcccagattcatcttttaactaaggtccatctataaaccaaacaacatcagtgttagtaagggtagtctcctgcaggagtgttctagaagagataagcttgtcagttaagattacgcaatcatgcagcatctcatctgaaggtagaggcagaagggtggcagggtttatattattgcacctagagcttgtaaggtgaggtacaaaaagaagaactacataaaaagctagtctgctgacagaataatgttgagtgtggtttgaatttagaagtgcttccacagaatatggaatgaagacagtgaggggaatcccatcgccattttttcagggttttttttgtttttttactaaaagagcagtggcagttactctcttcaggcagtgtggcaatcttttagccatggcatccacttgctgactacagtatcctgtaagtctattttggtctcagtgtttttgtgacataacacctaaagcatttcccttatttttatggacaaacaatgaaatggaatatagatgctggggtatttataaggctctttgtaatctcttccaaagttaacgaattttcctcagtccattccaggggatctggcttgtgtttctttaaaagagtatatagatgttgagttgtttttttttaagcttggaatccaatttctacagtatactgccagtcccccaaatcctcttggttgtttcttagtttgggggataggaaggccaatatttcttttattctatcctggtagataaaaagaccttcccttgatattagatgacccaaatatcttacctgtttttgacaaaactgaagtttttcctttgacaccttgcattcctttaaggctaattgttgtaataagtgaatcccatcttctatagaggcttctttatcctctgaactgagaagcaaatcatctatgtattgtattaaaatggatttcttaaggaagtcaatatctgagagatctgcttctaatattttttaaaagtaagttgggcattcagtgtatccctaaggcatgagtttccaaatgtgttgtttgtcttcccaagtgaaggcaaagagaaattgaatgtctttatccataggaatactaaataatgcactatataacttaatcacagtaatgattcacattaggtaaggatagcagtcaaaaatgtatggggctttagaactaccagatggtgaggaatgattatattgttaattgctctcacaccctgtacaaacctccatgctctatcatttgcatttcttacaggaagaattggagtattacatgggtatgtacagagaataatcagacccctttttatatagtctagaactatgagtcttattccttccaaagcttctggttttaaagggtattttttaaagtttagatgaggtttttgtgggtctatttgaatttttattggagaagctaaatccctccatcttctaacccctattactaccaaaaacctagaatctgcattttcaaattatagacactgattcccatacccgtggaggggggaaagctgctctctcaaccaaatctccaaatagcacttgtggtctctcaaatttatattcccagaattaaggctacaaacttgaaatcaattaaaataatcaaagagctagaatggggtgggttgggtatggaaattcagttttatcttagtagtgctaagagggaaaatatacctgtaaatgctaacattaaaaaagaaaaaagatatctcatctataacctaaccttacaccttaaagaactagaaaaataacaagcttaaccaaagctagcagaaataaataaaaataaatattagagcagaaatcattaacatagagaatataaaaagtagggaaaaacaatgacgccaatagttggttctttgaaaagatctatgtgactgacgtatatttagctagattaagaagaaaagagacaaataactaaataactaataactcaaataactaaaagcagaaatgaaaggacattacaaatgattttgcagaattaaaaagcattattaagacatagtataattgcacaccactatgatgacctaaatgaaatggataaattcctagaaacagacaaattgccagaactgaatccagaagaagtagaaaatttgaacagacttataactagtaaggggattacatcagtaataaataaccaaaacccctggaccggaatgcttcactgctgaattctaccaaacagctaaaagaagaattagtaccattccttctgaaactcttccataaaaattaaaggaggaacacttctacagtcattctgagaccagcattatcctgatactaaagccagacaaaggcactaccatcagaaagaactactgcacaatatctcggatgaacattaatgcaaaaattctcaacaaaatactagaaaagagatttcatcagtacattaaaaagattatacaccatgacccagagggatatttttcttggaatgcaaaaatagttcaacatgcaaaaatcaaagtaatatatcacattaacagactgaaggaaaaaaaccccacatgatcatctcagttgatgtagaaaaagcatttgacaaaattcagtaacttttcatggaaaaaactctcaacaaactagaaatagaaggaaatttcctaacataataaagaccatatatgcaaagcccacagctaacatcatactaaatggtggaagattgaaatcttttcttctaatatcagaaacaaaacaaggtttcttagtttcaccatttctattcaatataattcttgaggtcctggccataagaattaagcaaaaaagaaataaagggcatacaaattggaaaaagagaagtaaaattacttctattcacagatagcatgatttcatatgtagaaaaccctatagagtccacaccaaaaaaagctgttataataaacgaattcagcaaagttgcaggatacaaaatccacacacaatcaacacacaaaatccagttgcatttctacatactaacaatgaataatctgaaaaggaaattgagaaaacaattttatttgtttcaaaaataaatatttgtttattatttcaaaaataatgaaatacttaataactttctctcttcaacaaatagcgtctggacaacttcatatccacatgcaaaagaatgaagttgaacccttgccttaactcacatacaaaaattagttgaaaatatatcaaaaaactaaacaagaaaaacaactaaaactcacagaagaagacataggggaaaattttatgacattgaatttgtcaatgacttcttacatatgacatcaaaagcacaggcaacaaaagtaaaaaacagataaactggccaggcacggtggctcacgcctgtaatcccagcactttgggaggccgaggcaggtggatcacgaggtcaggagatcgagaccatcctggctaacacagtgaaaccccgtctctactaaaaatacaaaaaattagctgggcgtggtggctggtacctgtagtcccagctactccagaggctgaggcaggagaatggcgtgaacctgggagactccgtctcaaaaaaaaaaaaaaaattaaaaaattaaaaaaaaaacagagaaatcggactacattaaaatttaaaacttctgtgcatgaaaaaatataataaattaaaagacaatccatagaatgggcgaatatatttgcaaatcatatatctgataaggggtttaaaaagaacttctacaactcaacaacaaaaagcaatccaagtgaaaaataggcaaaggacttcaatagacatttccctaaagatgatatacaaatgggcaataaacacatgaaatatgctcaacatctttttgtatcagaaaaatgtaaatcaaaaccatgatgagacagcaccttacatacattagaatggctaatacaaaacaaaaaacaaacagaaaacaatatgtgttgacaagattatttttaaaaatctgaaatcttgtacacttttggtgggaatgtaaaatggtgaagctgctgtggaaaacaacatggcagttcattttaagaacggaattaccatatgatcctgcaattttacttctgggtatgtatcccaaaggatgtaaagcagaataatctctctttcatcttaaaaaaaacttgtttaaagactgaatacatagaaacagagtagaaaagtggttaccagaggcaggggtaggggtggagggaggaactgggagatgtagtttaaagggcacaaagttgcagttacttaggatgaataagtctagagatctaacatacagcataatgattatagttaataatactgtagtgcatactggcaatttgctaagagagtagattttaggtgttcttaccccaatacacaaaaggtaactttgagagactaggatagatatgttaaacaacttgaacacagtaataacttaacaatatatttatatcaaaacatgttgtatgccttaaatatatataagttttgaaaaaaagaatttcaagcatggtcttagagatttgcacacccatgtttatagcagcattattcacaatagtcaggaggtagaagcaacccaagtttctttcagtgaattaatggataaacaaaatgtggtatatacattcaaggaaatattatcagccattaaaaggacagaaattctgacatgttataacatggatgaaatttgaagatattatgctaaatgaaacaagccaatcacaaaaagtgaaatactgtatgattccacttatatgaggcaaccagaatagtcaaactcatagaaacaaaaagtagaaaggtgtttgtcggggctgagggagaaatgagaaatgaggtgttgtttaatgggtatagagtttacgttttgcaagatgaaaaattcctggaaactgattgcataacaatggaaatatacgtaaaactattgaactgtacactttaaaatgtttaagatggtagatgtcatgtgtatctcaccactattaaaaatttttaaacagcagtttcttattgcatgtctgccatgtgtcagccactatactctgttctttttcatgatttttaaagagatatctctctcaagctcctcacttcctccttaactcattctacaaagccagcataccatgataccaaaacctggcaaaaaaaaaaaaaacaatgaaaaaagaaaactacaaaccaaaatatccctgataaacacaaatgcaaaaatccttaacaaaatactagcaaaccaaattcagcagcatatcaaaaatccaattcaccatgatcaactaggcttcattcctgggatgcaaggttggatcaacatatgcaaatcaataaatgtgattcaccacataaacagaattaaaaacaaaaatcatatgatcatctcaacagatggagaaaaagcttttgataaaatccaacatcccttcatgataaaaacccaaaacaacatattagacatcaaagcaacatactgcaaaataataagagccatctatgccatacccacaccaaatatcatactgaatgggctaaagctggaagcattccccttagtaacttgaacaagacaaggatgcccactcttaccactcctattcagtatagtactggaagtcctagccacagcaaacaagcaagagaaagaaataaaagccatccaaataagaaaagaagaattcaaactatctctcttcactgataacatgattctatacctagaaaaccctaaagactccaccaaaaggctcctagaactgataagtgacttcagtaatgtttccagatacaaaatcagtgcacaaaaatcagtagcatttctatacatcaagaccattcaagctgtgagccaaatcaagaatacaattgaatttacaatagccacaaaaaataaaataccaaggaatacagctcaccaagaaagcaaaagatctctacaaggataactacaaaatgctgctgaaagaaatcataggtgacacaaacaaatagaaaaacactgatgctcatggagtggaagaatcattatcattaaaataaccataatactgctcaaagcaatctacagattcaacgctattcctgtcaagttatgaaagccattttttttcacagaattagaaaacaccattctaaaattcatacggaaccaaaaaaaagagcccaaatagccaaagctaagaaaaaagagcaaagctgtgggcatcacattatctgacttcaaactgttatagggctagagtaaccaaaagagcatggcactggtacaagaacagcacataaaccaatgaaacagaataaagaacccagaaataaagccacacaccaatagccatttgattttcagcaaagttggcaaaaataagcaatgaggaaaagactcctgattcaataaatggtgcttggatactgtatagctatatgcagaaaaatgaaagtggactcctacctttcaccatatacaaaaattaactcaagatgcattaaagatttaaatgtaagacctcaaaactattataatcatagaagaaaacctaggaaacatcattctggatattagccttgggaaagaatttatgactaaatcctcaaaagccatgggaacaaaaacaaaaattgacaagtgggacctaattaaactaaagagtttctgcacagcaaaagaaactatcaacagagtaaagagacagcctacagaaggtatgaaaatatttgcaaactgtgcatccaacaagggtctaatctccagaatctataaggaacttaaacaatttaataaacaaaacataaataactccattgctccatatcactaatcatcagggaaatgcaaatcaaaaccacaatcagccagaatggctattactaaaaagtcaaaaacaacagatgctagcaatgctgtggagaaaagggaatgcttacacactgttagtgggaatgtaaattagttcagccactgtgtaaggcagtttagagatttctcaaagaacttagaactaccattcaacccatcaatcacattgctgagtatatatccaaaataaatcattctaccagaaagacacatgcactggtatgttcattgcagcgctattcacactagcaaagacatggaatcagcttaggtgcccatcagcagtggactggataaagaaaatgtggtacacatacacctggaatactagggagccatacaaaagaacactatcatgtattttgcagcagcatggatgcagctggtggccattatcctaagtgaattaacacaggaacagaaaaccaaataccacattttctcacttataagtggaagctaaacactgaatacacacggacataaagatggcaacaatagacactggcaagcactcagggagaagtagtcggggggaaggaggcgaagggatgaaagactattacatactatgctcaatatctgggtgatgggatcagtcataccccaaacctcagcatcacacaatacatccatgtaagaaaccagtacatgtaccctctgaatctaaaataaaagttgaaattattttttaatttaaaaaagtgtacacaagttttaaaaattaaaataaatggaattgatatacaatagttgtacatattacatattttaggggtacatgtgatattttgatatatgtatatgatgcataattaaatcagggtaactgggatatccatcatctctaacatttatcttttccttgtgttagggacattacagttctcttctagctattttgaaatgtataacaaatcatcattaactataatctctctgctatactatcaaataatagaatgtattccttctatataacaatatgtttgtatctattaacccacttctcttcatccccctctcttctacccttcccagcctgtagtatacactattctactctctatgtctatgacatctactttttaaggtcccatatataagtgagaacatgtaatatttgcttttctgcacatggcttatttcacttaacataatgacctcaagtttcacttatgttgctacaaatgacagaatttctttctgtttcctagctaagtaatattacattatatggagattccatattttttattcattcatttgttgaggggcacttaggttgcttccaaatcttgactattgtgaatagtgctgcattaaatgtgggaatccagatatctctttgatatactgatttctctactttgggatatatacccagcggagagattgctggataaaatgatagttctattttcatctttttgaggaactaccaaattgttcatcccagtggttgtacaaatttacattcccactaacagtatttgagtgttttagtccgttctcatgctgctataaagaactgcccaagactgggtaatttataaagaaaagaggtttaactgactcacagttctgcattgctggggaggtttcaggaaacttacaatcatggcagaaggcaaaggagaagtgggcactttcttcacgggggggcagaacagagtgagtgcaagcagaggaaatgccagacacttataaaacgatcagatctcatgagactcactcactatcataacaacagcatggggaaactgcctccatgatccgattatctctgtgtgatcacacccttgacatgtggggattatgataattacaattcaaggtgagatttgggtggggacatagagccaaaccatatcattccaccgccccctctgacacctcccaaatatcatgtcttttcatatttcaaaaccaatcatgccttcccaacactccccaaaaatcttatttcagcattaacacagaagtccacagtccaaagtctcatctaagacaaggcaaatctcttctgcctatgaatctgtaaaatcaaaagcatgttagttacttcctagatacaatggaggtacaggcattgagtaaatacacctgttccaaatgggagacataggtcaaaacaaaggggcaacaggccccatgcaagtccaaaatctaacagggcagtcattaaaccttaaagttccaaaatgatctcctttgactccatgtctcacatgcaggtcaagctgatgtaaggtggctcctgtggtcttgggcagttctgcccgtggctctgcagggtacagccccactcccagctgcttttgtgggctgatgttgagtgtctgccacttttctaactgcacagtacaagctgttggtggatctaccattcaggggtctggaggacagtgaccctcttctcacagatccactaggcagtgccccagtggggactctgtggggggggttctgaccccacatttgccttctgcactgccctaccagaggttcgccatgagggattcactcctccagcaaacttctgcctagacatccaggtgtttccatatatcctctgaagtctaggcagaggttcccaaaccttaattcttgacttttgtgcacccatgggctcaacaccatgtggaacctgccaaggcttggggcttgcaccctctgaagcaatgacctgagctttaccttggctgcttttagccatggttggagctgaagcagctgggacacaggacaccatgtcatgaagctgcatagggcaggggggcagtgggaccggcccaggaaaccattttccctcctaggcctctgggcctgtgatgggaggggctgccctgaagttctctgatatgccctggagacattttccccattgtcttggtgattaacctttggctcctggttacttatgcaaatttctgcagtgagcttgaatttctccccagaaaatgggtttttcttttctattgcatagttaggctacaaattttccaaacttttatgctctgcttcctcttgaatgctttgcaacttagaaatttgttctgccagataccctaaatcatccatctcaaagttccacagatctctagggcaggtgcaaaatgccaccgccctctttgctaaagcataggaagagtcatctttgctccagttcccaacaagttcctcatctccatctgagaccacctcagcttggactttgttgtcctttcctacatcttcctgtcttctgaaccctacaagtctctaggaagttctaaactttcccacattttcctgtcttcttttgagccctccaaactgtttcaacctctgcctgttacccagttccaaagtcacttccacatttttgggtatccttatagcagtgccccactaccttggtaccaatttactgtattagtccattcccatgatgctataaggaactgccagagactgggtaatttataaaggaaagaggtttaattgactcacagttctgaattgctggggaggctcaggaaacttacaatcatggcagaaggcaaaggagcagcaggcaccttcttcacagggcagcaggatggagtgagtgcaagcagggaaaatgctagacgcttacagaaaccatcagatcttgtgagcctcactcactatcatgagaacagcatggcagaaacagccccatgatccgattacctccacctggtcacgcccttaacacatggggattatggggattacaattcgaggtgagatttgggtggggacacagagccaaaccatatcaatgggtatttccttttatctgcatccttgccagcattcattatctttcatctttttcataatagcaactttaggccatactgtccaaagaaatttatagattcaatgctattcctatcaaactatcaacaacattcttaacagaactagaataaactattttaaaattcatatggaacccaaaacagagcctgaatagccaaggcaatcctaaccaaaaagaacaaagctggaggcatcacattatccaacttcaaactatactacagggctacagtaatcaaaacggcatggtactggtacaaaaacagacagacacatagaccaatggaacagaacagagattccagaaataatgctgcacacctacaaccatctaatcttcagtaaaactgacaaaaacaagcaatggggaaaggacttcctattcaacacatggtgctgggataactggctagctatatgcagaagattgaaactggaccccttccttacaccatatataaaaatcaattcaagatggactaaacacttaaatgtaaaaccccaaactataaaaaccctggaaaatagctaggaataccatcctggataggaactggcaaagatttcatgactaagacaccaaaagcaattgcaacaaaagaaaaattgacaaatgagttctaattaagctgatgaccttatgtacagcaaaagaaactatcaacagagtgaacaaataacctacagaataggacaagatgtttgcaaactatgcatctgacaaaggtctaatatccagaatctataaggaacgtaaatttataagaaaaaaacctcattaaaaagtgggcaaaggacatgaacagacagttctcaaaagaagactttcatgcagccaacaagcataaataaaaacactcagtatcactgattgttagagaaatgcaaatcaaaaccacatgagatatcatctcacaccagtcagaatggccattattgaaaagtcaaaaaataacagatgctggtaagttgcagagaaaaagggacacttctacactgctggtgggagtccaaattagtgaaaccactgtgaaagacagtgtggcaattcctcaaagaactaaaacagaactatcatttgattcaacaatccaattactgagtatatacccaaaggaatataaatttttctaccatgaagacacatgtatgtgtatgttcactgcagcactattcacaatagcaaagacatcaaatcaacctaaatacccatcaacagtagactggataaagaaagcgtggtacacatataccatggaatactatgcagccatcaaaaagaatgatatcatgccctttgcaggaacaattgatggatctggaggccattatccttagcaaactaacgcaagaacagaaaaccaaataccatatgttcttgcttataagtgagagctaaataatgagaacaaattgacataaaagggaacaacagacactgggccctacttgagggaggaaggtgggaggaaagaggatcagaaaaaataattattaggtactgtgcttagtacctgggtgatgaaataatctgtacacaaaacccccatgacatgagttcacctatataacaaacctgcacaggtaccaatgaacctaaaataaaagttaaaaataaaagacaatagccatttcaactgggatgagatcatatctcacagcaaaacctgtgatatacagtgaaagaagtactaagaagaaagtttgtagctataagtgcctacatcaaaaaactagaaaaatttcaaatcaccaacgtaatgatgcatcttaaagaactaaaaaagagcaagcaaaacccaaaattagaagaaataaaaatcagagcagaaataaatgaaattgaaataaaaaacatatgaaagatcaacaaaaagttgccttcttgaaaagacaagcaaaatcaaaaaactttcagccagactaagaataaaagagagaggacccaaataaataaaattagagatgaaaaaggagacattataaccaatacctcagaaattcagaggatcattataggctactatgataaattatatgccaaaaaattagtaaatgtagcagaaatggataaattcctagacacatacaacctttcaagattgaaccatgaagaaatctaaaatcggaacagaccaataacaagtaatgagataaagcatttaaagaagaatagaataccaattctactcaacctatcctgaaaatagaggagcagggaatatttccaaactcattctatgaagtcagtattaccctgataccaaaaccagacaatgactcatcaaaagaaagaaaactataagccagtatctctgatgaatatttatataaaaatcctcaacaaaatgctagcaaaccaaattcaacaacacattaaaaatatcatttatcatgactaaatgatatttatcccagggatgcaaggatgactcaacacacacaaatcaaatcaatgggatacatcatatcaacagaatgaaggacaaaatctatatgatcatttcatttgatgctgaaaacgcatttggtataattctacattccttcatgatataaaccctcaaaaaattgaggatagaaggaacataccccaacacaataaaagccatatacaacagacccacagctagtatcacactgaataaagaaaaagcaaaagcctttcttctaagaactggaacatgataaaggatgcccactttcaacactgtgccagaagtcctatctaatgcaatcagacaagagaaagaaataaagggcatccaaattggaaaggaagaaatcaaattatccttgtttacagatgatatgatcttatatttggacacacctaaagactccacctaaagacttccaagacctgttaaaactgacaaattcagtaaacttgtaagaaacagtatcaatatacaaaaatctgtagcactcatatatgccaacagcaaacaatcagaaaaagaaattttaaaagtaatcgcatttacaataactgcaaataaaattaaatacataggaattaacttgaccaaagaagtgaaagagctctacaataaaaacaataaaacattgatgaaagaaatagaacacaaaaaaatggaaatatcttccatgtccataaaatggacaatgtccattaaaaaatcaatgaggttaaaatgttcacagtacccaaagcaatctatagagtcaatgcaatccctatcaaaataccaatgacattcttcacagaaacagaaaaaaaatcctaaaatttatgtggaatcactaaagaccccaattagccaaagctatcctgagaaaaaaagaacaaaactcgaagaattatattacctgacttcaaattatactacagagatatagtagccaaaagagcatggtactgacataaaaacagacagacaaatggaacaaaagggagaacccagatataactccatccatctacagtgaactcattttcaacaaaggtgtcatagtatacattgaagaaaggacagtctcttcaataagtgatgccaggaaaactgactatccatatggagaagaataaaactagacccctatctttcaccatatacaataatcaaatcaacgtgaatcacagacttaaaactgagaccttggactatgaaactactgaaagaaaacattggggaaactgcccaggacattggactggcaaagatttctggaataataccccacgagcacaggcaaccaaagcaaaaatggacacatgggatcacatcaagttcaaaagcttctgcaaagcaaaggaaacaatcaacaaagtgaagagacaacccacagaatgggagaaaatatttgcaaaccatccatctgccaagagcttaataaccagaatatataaggagctcaaacccttcaatggcaaaaagtctaataatccaatgaaaaatgggcaaaagatctgaatagacatttctcaaaagaacacatacaaatggcaaacaggcataggaaaagttgcccaacatcactgattatcagatatatgcaaatcaaaactacaatgagatatcatctcatctcagttaaaatggctttttttccccaaaagatagccaataacaaatgctggcgaggatctggagaaaaaagaaccaccatacactgttagtgggaatgtaaattagtacaaccactataatgaacagtgtggaagttcctcaataaactaaaaatagaactatcatatgatccagcaatcccactgctagatatataccccaaagaaaggaaattagtatatcaaggagatatctgtactcccatatttattgctacactattcacagtaaccaagatctggaagcaacctaagtgtccatgaacagatgaatggataaagaaaatgtggtacatatacacaatggagtactattcagccataaaaaagaatgagatcctgtcatttgcaccatggatagaactggaggtcattatgtgaagtaaaataagccaggcacagaaagacaaactttgcatgttcttgcttatttatgggagctaaaaacttaaacaattgtgaaatagagagtagaatgatggttaccagaggctgagatgggtagtgggtgggaatgagtgagtgctgatggtaaatagggacaaaatcatagacagaatgaataatatctagatttgatagtacaggatgactatagtcaactattatacatttttaaataactaaaagagtataataggattggaacacaaataaagggtaaatgcctaaggtgagggataccctattttccctgatttgaatacaatgcattgtattcctgtatcaaaatacctcatgtaccccataaatatatatacctaatatgtacccacaaaaattaaaaaaagaaaaaaagaaaaaccatcagcttgtacacttatgatttgcataaatttatgtatctttacttgaaaaaattaagactggcttccagatcagagcacaaccaagacttactatatctactaaaagaatgcataagtcaaaagatggttggttggtcagggatggaaacaaatactgacaattcccttctgaacactggacttatctttagtctcatgctcttaatgagaaaactatagatatagatatgttaaatgtaagttagctctcccccaccccatcgtctggttcctatgccactatagccaattattcttcactctacaccaatctagatctagaaatcagacttagcttcaggttcattctatcttacatatgtacacacacatactcctttcatactcaccagatgtgaggcctagaatttctccaggcatcgtaggatcttcagaataaggatgaagccagcaatgaggatttcagtaaatcaccaatctctttcttgaatcttctttctctgacacactgatataaacccttccattatgtagtccctacctgtaccctctcctgtctgctggctcactccttctggatgccttcctcaccctaccccctaggaaccaaaaatataattctcttatattctgttctatcaagcctctggaagttctgagatgccaagaataggaattgggaaggaaggttacaacagaggtgacatgatatatgtctttgagtccttagcatggcattcaaggttcctcataatcttactcttgctaatctcattaaaatcatctccctacaccatttccattcacatttaacacgtgtgtttgcagctccacttcacccatacaccattctatttctaacctctgagccattgctcacacaattcttttttgtctgaattacccccgtatctcttaaaccatctgcttatccatttacacataactgaagtgccatctcttccaaaaagtcttcctttaccataacatttacaacactctaataaaattacctatgtgtttgtctctcccaccagattgtgagagctttcagggcagaactatttctctgattttcctctctaagcctcactgtactgtaggtgtttaacaaacaccttctcactgtacagtgtcaatgaaatagaatagaaggggcaatcattttgagggaaaggaacaaggggagtagattatgtgtgatttagaatcacacatacctggatttgaatctctgctgccaatttcatagcagaggggcctggccaagctcctatgtcctcctccatgtagtgaattgactcatagtgcacgtatgagtcagtaaatgggagagagaaacacaagacttcagggtcaggttgcctgggttcatatcagcttcattactaacttctagtgtgaccataagaaattttctgaccctctctatgcctcagttctctcatttgaaaaataagctttgtaataattcatttctcttagagcttctggaaggattaaattgtgatgaaacctgatagaatagcactatgcaaatgttaaatcgttattaaagttagcaattattatcacataaaatggggatcataatactacttatttcaaaggtactataagcatatacagtggatgagtaaatgatagttgttaccattaatttatatatgtcaaataaagaacatttatatatttttacaaagaaactagagtgtagctgaggtaggaaaaataaattctgagaactaaaatatcattctaaaactctacttaaaacaaaaatcttaggccaggcatggtggctcacacctgtaatccctcctttgggaggccaaggccggcagattacctgaggtcaggagtttgagaccagcctggccaacatggcgaaaccccgtctctactaaaaatacaaaaattagcccggcatgctggtggattcctgtaatcccagcaagttgggaggctgaggtacaaggatcgattgcttgaatccggaaggtggaggttgcaatgagccaagatcgtgccactgcactccagcctgggcaacaaagtgagactccgcctcaaaaaaaaaaatcttgcccaatcctagtcaattttcagcatcactacagagaagaaaaaacaaaagaggatttaatattatgtactaacacatgcagtgaaaatgacataggcttcggagtcagatacgacacacctgcattctaatcctggtcctatcacttaagtcattgtttccaataaagcatcagtatttagggtttttccttggaagatgtcttccaatacgtttcttcactgtattcagcaatttttttaaaacaatcccgaggcaagcaatgcctggaagatgcggttgagaataaaaatgaatgacattgtcactaagggtgagctcaaggtaatgaaaactgcatgagacactggggccagacagacctggagttgaaaacggtttccacctctgccttgctatgagaccttgggtaagttacataaactctctggctctcagacgactcttctgtaaattgagataataatagtatctgcttcacaatcacgtcctctgagaggagcctatgctgatcctgcccacctacctatggctgtggttaaggagtcttagtctgtgttcccagagcccactgttgttgttattttacagatgaaaggcatagatgtcattctgggttaccctgaaagaaccaagaatgtgaacccaaagattagtggaattgtcaaaaacagatgagcctcacacttacaaggagacagctctctcaagtttcctgtttcttctttaaccattcatccccagtccatctcagtctgcagcttttctctttgtgtctctctatgcattctcatcatactcctaaacgacttacaattcttcacttgaagccctttcatgtaatttttctgtgtgtctggctaccacacaagactgtgagatgcttgaggaaaaggatcgagttatgttggcttttacccacccagcaaccagaacacttcctgaatcttggcacaaaaactaaaaatacatccaacgaaaactgaaaacttattgaaaaaaaagtttagaaataatatgtatatatatacatatatataatatatccagttcctctctgctgtattaaatatttcaaataaataaactccccattgcatctgggatatattattcccttttttaaaatatgagattactgggaaccagagaacttcggagtcatttccatggttacagggcaggtatgtaacagcatgagcacggaaaccctggtatgtaatgccaacgcacacaaggacggcagcataggcaatctccatacctatgtgtggacaatgtaaaaatacctcttgggagaaggggctgcaaatacagtttaccaacatgttacaccagtaaagctgtcattttgagataaagggaagggtctcccggacccattttcaacaagtggccaatcttggtagtgcagactaagaagcagcccagtaagttcttagaaccggaaactcccctccccccaaacacccaaccgcgcagcccacgctgcggggccacgacttggccggatttatgttcatggctgaggatgccatgggccgagtaagaaggagaaccgccacccaaccacgcagccaagagcaacccagggatccctcctctgcttgctcccctcccccacccctgctgtaccttctgcgcagccatctcggtaacgggcgtcaggggcgctcggcggcctgctgtccaagctggggtcaggagcctggcggtagcaaagagcatcaccgaaaggaagctggtaggctagcgaggccagccccaaagacccacagatacacgcgctgctccgaactcgcgggcccgcggcgtccactaatgagatgaacctgggcgcgcagcggctggacctcagctgctagggcgccgccaaggccctgctggacaccttctggtacctgggcctcgtgtattacacctgtggctgccgccgaggcgcggttcaatttgaagtctgagcccctacaggcccgtgaatcctggattacaactgcagtttgtgcaagaagcagcagcacctgcacttccacttagcaacctccggcttcacgctcctccagggcgcagagagcatcaaagcattatcaccgacccaacacacaccggcgctgcgtagtttctgcagcaggtgtggggtgaagagttgccacacagctgtctgacaccgggtgtacggcgtcacccctcacttcctggacaaggcaacattttcctaaaggtaaagaccatgaacatgtagaggcccccttactctcatgctagtccgcattcagccggaagcaattcagcaaatttgccatttaagtgacgccctggatctgtctttcagagtagtggcttaccctgcagcctcatttctctgataagtatttttttaaagccattgattcagtttgttcatctttttcttgttggaagaagggggtggggtgacaatttccagcttctttacatgaaagagctgaaaccagaagtctcgcttgtgaccatttttgcaatatactacaatcactataagcctatgatttagaaatatcatggtaaatgcctgagaagcagaaaaaatagttgaaagaagttttctcagggagccagagcaggagtgggggcgagtatggatttagattcaaatgatttctggtttcattaaaggctagtgttattctttaagaacttttaagatcatgtatgtatattattttgagaaaattaaagaataagtgatgcattttatgtagaaataatctatataaattctacatagaaaaatacgtagaaataccaagtttaatttcaagattaaataaatgctcaaaaatacatacaattcctaaaacagttattaccacttacttgttaatgttagttgtgactgtttataaattaacgtgcacattttactcttgatccaaatgctactgtttgaacattaattggcttaagtaataatttttaaattgtacttcacaaaatttagaggaaacaatgcaagggaagggactatattcccatttccctgatgaagacactaaagcttaaaagattaggtaacttgctgaaagtcatgcactaagtaagtggttgactggcacagtctcacaaatccatctgctgttatgtatacctctctccctctacacatttttgaatagccatgcctttatcagaaaaaatggtgttactcttccactaggattgggaaccaaaattactgataaaagtacaaggagagttgaatacgatctttcagttcttttcaagaatcacaaatccctaagccaataaaaaagtttagaagctagaagcaaagacagagatcttccaaatttgtttaatgaaggaagtctaaactctgattccaaaacctggcaaagatagttcactacacacaaagaaagatgtggatctctctcacttattaacttatatttaattttttattaataaaatttgggtccataaaattaaactgtatataaaaatctatcatatcctggtagtttcctagtcatgagagcatgatgtaatattaggaaatattttaattaaccctccacagtatataaaaatccatcatatcctggtagttttctagtcatgagagcatggtgtaatattaagaaatattttaattaacccattatatcaataggtcaaaggagaaaaatcctatcatctgaggtgctgaacaaagaattcaataaattcaatcaatctgatgcactctgcagtcgttctaagttcttgtctactaaaatcctcgactactacacatccacaatcgcttctgtgaaactcttgggaccaaatggttcagaatttgtctcccatacatacataatatctatgtcaaggcctgtagtaatactgtggaatctaatacaatgatatttctgtagtgaaacatacaaatgttcactccaagatctaaagattacaaatagcatcatgtcagttcaaatcaggttttatggataaatgagtcaggaaaagtatgtttttcaaagcattttgaatgttagacttgtgcacaagggattgtgagtctgaatcatatttccgtcaactcttcttgcctttcatacaatttttttctttctgttatcttttttatcattgaaatacaacatttagatagaagattgtgcaaatcataagggacaacaagttgatgactttttacaaagtgaacacatgcatgtaacaaccagtaagaccaaaatatagaacattactggcaccccagaaacttatgttatacccctacctagtcattacccctgaaatttaagcactattctaacctatgttactatagaattgttttgccggctttttatactttatacaaatggaattataaattatgtatatttttatgcctggtttcttttgctcaatatgaatgcttttaagatctgtacactttgttgcatgtagggatatttgcttgtttcgttcctgaacagtattccattgtattaatataccacaatttattcattcaactgttgatatatatttaggttgtttctagtttgtgactatttccaataatgccactgtgaacatccttatgtcttttgaaaaacaggtttatgtatctctgttggatatatacttgtgtggtaagcagaattctaaggtgatctccaatgactcttgtcttggtataatctcttcccattgggtgtaggtggaacctgtaaatatgatgagatcttacttttatgattatattacttcatatggcaaaaaggatcttgcagatataattaaggtcacaaatcagttgcccttaaagtaggtgaggcagacctaatcaggtgagcacttacaagggcccaggtttttgctgagagattcgaagcatgagagagcatttggagggggccacgtgacaaggaactgcaggagtcctctaggtgatgagttgctgccccttgttgacagccagcaaaagaatggagggacctcagtactacagctacagggcactggactcagctggcaacatagatgagtctgcaagggcttcttccccagagatccagaaaggaacacaggaagtccaagagcatctcaccctgtgagaccttgagcagggaaaccagtcacatggtgcacagacctctgacctacacaactgtgagctaataaatgagtgttggtgtaagctgctaagactgtagcaatgtgtttaacaccaacagaaaccactatagattttgatacctggatgtgaggtgtagtcactgtaaacaccttaaaatgtagatgtggctttggaactggatagtaagcaaaggctggaagaattttgagatgcatgacagggaaagcctaaattcccttggacagactggtagtagacgtcagctggatatccaaactgctttggaactcctcttttctgccttctgttttctcctgtataaaatagaatgtttatagatgttatcctatgcccgtcccatcattgtatgtggtggtgttgggggaagatagcttgtcactttagtgctgatggtccacagttggagagggattttgccctaggagttttactggataggatcatacccaggaatctcatccgttcatgattcagatgatgaaattcagatgagcttttggaattgagctgatgccataatacaaagaaatttggagactgtgggatggattgaatgtattttatacgtgggaaatactggatcactgagggccagagggcaggctgaggcaggcagaattctaagatgacctctaatgacctctggtcttatatgaacttctcttgagtataagagcagcctgtgaatatgatgagataccactcctatgataatgttacacaatatggggaaagagattttgcagatgaattatgctcccagatcagtgaacctcgaaataaggaggttgacctgtgtgggccagacctaagtaagtgagcccttaagatggcctgagcccttcctgggagactggaagtgtgcgaaggaatatgtagagctctatgtggcaaagaactgcatgaggcctctaggagctaaaaattgaactgaattctgccaattacctgaatgagtttggaaatatattcctcctcagtctccagaaagaaacacagactcactgaccaatagaacaggctgacttcaccctgtgagacttgaacagagtacttgtaaacctatagaactgggagcttaaataaatggccattgtttaaagccattaaatttgtggtgatttgttactcagggatagaaaagtaacatagatggaatttctgggttatagaaaatgcataaattcagctttaataggtactcccaaatagttttccaagggtactaatttacactcctaccggcagttagagtttcagttcctctatagcctcccctgctctttatattggtagtcattctagctattctggtagatgtttgctgatgtcttcttgtgattttaatttgcatatctctgatgacttattttgggaagtctttgttatttgtcagtttaatatcctattttgtgaagtacctgttgaaatattgtgccagtgtttaactgcatttacttttattctttattttattctgtacataaaacattttctgaatgtgtgcgtgcatgcgtgtttatttgtagttaatgttttcctttatcgttagtggtttttgtgttgtgttttagatataatttaccccaaggtcatcaagatatgattgtatcttattttctagaagctttatctttttgaattcattttgtgtatggcataagttaggagccaaagttatttttttctatatggctggatatccaatttgtccagttccacttacttaaatgattatctttctccctgagtactgcattggtatctttgttgtaaataaggtgatcatatgtgtgtgtctgtttgtggactctcttcttgtcctattggtctatttatctatctttatctaaacatatatatctttatttatctattcctgcgtaacaaaatgttactgtacacaaatcatactatcttaattatggcttttctgactgtgaaagttcttcaaattcttctagatggctttggctgttcttagatctttgatatccattcatattttagaatcagtttgctggtttacattttcaaattatctgttgagattttgatttgtattgcattgaatacatagactgtttggatgagaattttctctgatttaattttcataatattctaatctacaaacatgacatatctctgattaacgtagggcttctttatttaagaaatgtcatgttgatttctggacaaaggtcttatgaatttttttattagatttgttcctagctatttgatattttctgatgctataggaaatggcaattttaaaatttcctctttatactttttactgctaatatgtggaaatacaattccattgtgtaatattgaccttatgtccactgattacaccaaattcatttattctaatatttgatatatattctttaatttttaagtgtaaaaaacatgttgtgtcttttattttttcaagagctgagaaacctttccccccaaaaccttaaaacacaagcatccatatcttattgactgcaactgggaaatgactattcccaaaccagtcactggagtggtagtgagattactatgacctggttagtcaatcacactactatatatatatccgctacactgtgttataaatcaaattttctttattttaaccacatacgtaaatatttagacattaattttattagaagtttgaacatctctgttggattgataattgtggaatattcctccatctaaatgagctgaaattacagatcttaaattttataaattcttagcaatcaggccaggcctggtggctcatgcctgtaatcccagcactttgggaggccaaggcagacagatcacttgagctcaggcattcaagatcagcctggccaacatggtgaaaccccatctttaccaaaaatacacaaatttagctgggcatggtcgcacacgcctgtaatcccaactactcgggtggctgaggcaggagagtcacttgagagggggaggctacagtaagctgagatcacaccactgtactccagcctaggctacggagtgagacttggtctcattttaaaaaaaaaatcacacctgtaatctcagcactggcagaggcaggtgatcacttgaggtcaggagttccagataagcctggccaacatagtgaaaccatgtctctactaaaattacaaaaattagctgggtatggtggtacacacctgtaatcccagctacttgggaggctgaggcaggagaatcacttgaacccaggaggcggaggttgcagtgagccgagatcacatcactgcactccagcctgggccatagaacgagactgtctcaaaaaacaaacaaacaataaattattaagcaatgagtagtatgcttaatatgtgaaaaatatttgtggcttattcaggaataatgaattttttaaatggcttagtttatttcaaaaatatactgttgattataaaatacaaaaatatcagaatatttaatatgtacatatatcagacttttaaacatagttatcagtcactggtaaaattgcttgtgatttaaattatcttaaacttttctaaattatctaaattccatactgcaaggtttgccaaacttcacacaactggcattttggaccagataattctgtgttgttggaggctctcctgtgcattgaaggggttgagcagcatccttgatggctatatactaaatgctggtagaactcctcctccccaattatggcactcttcagacattttaaaatttcccctgcagggcaaaattcccctagctgagaacaactgtactatggtgaacaaaattttaataactaggtagatgtaaaaataaacagatgtaaatatagatcagtagatacagtacatcatggttttttttttaatctcgtagccattttcctatggcattaaaaatttttcaaaaacatcctgtaacatcctatataagtttattctctaggcatctagcattctactggaaattgggttgtttcagatttttaaaaataattgacactataataatcacctttgagcatataacactgtaaagatatgagtatattttttagaattaatgcctggagaggaattatgcatttcatataagactttttataggtatcatcatatcatcaaattttcatcttggaaggtgctatgaatttataattctatccagtagtatatatgagagcttgttttgttataatagcttaaaacctgtttaaacataattcttttcagaaatacagtagctatatttgcttagtacaagagtgatatatgctcattgaaaccattcagaagatgaagtatgaaaagaacgaaaaaccacactttcagatttttttaatgagtacatagatacatatatacttttaaatggaacagaggcaaagagaaaggtgaggatattgaagacaacaatggagttaaaaagaggggcttctttaaagtttgagatcttggaggatagcaaaacaataagtagaagacatatatattcctttaaagagagcaagggtagatagcattttaattattactaagtcagggaccacgactaaggcccacggagattcaagaaaggaggaaaactctcagggaatagattgaaatgactcccaagtggaaaagtggatccataaaactggtgaaagttggcctacagaacaaagagaatagctataagtggggttcataccccaaaatttcaactatacagggaacagtggttaacatggtcataacagaatcactgattcccaccatcttcctgatcttttcaactgagcaagttttccctgtttcggtaagtggcaccatcatccataaaaatataggattcatcatttactgctgtccttccctcatgatctcacagccgttcaagtttccagcagaagtcccagacatcgaggaacacagacaatccatccccactatgtaccgtctgaattctagctctacaaaatccatgggaatgttaaaatggatgttgtttcatgacactaaattgtggaataatgatgagcagacatattctgttcatttttcttcttcacttatgtctatcctgtattttatcaatattttgttttccatattccattcttattgaattcctattctatccttcataaactgtattctatatttcattctaaatttcattctattccggtatttaaaaatctatactgtttatttcatagtccatttatttcaggccattgcacattttgttccgttctatattccttccaattttgatttccttttattttctttaatattttatttcatactgtattgcactcattccttttctcatatatttttattttattccatatgacattagatatttctttccattttctgttccattccattttccaattaaattccattaaatttccaatattccattccacatcctgttcaaacccgtattctactccccattttattccagtttccattgcagtctccatttcatcccatcctgcataccatttcaaatccattttccatactatattatttaacactccaaataccattccattctatttttgtgttgcatttcagcccaattgttcaccaattccattaaatatccgattttattgtgctcaaaatgttataacagtgacattcaggagactagtttgccaatatttttaatcaaagaattacaaatgtggctgggcgcagtggctcacgcctgtaatcccagcactttgggaggccgaggcgggcagatcgcctgaggtcaggagtttgagaccagcctggccgacatggtgaaaccctgcctctactaaaaatacaaaaaattagccggccatgggtggcacgcgcctgtagtcccagctattcgggaggctgaggcaggagaattgcttgaacccgggaggcagaagttgcagtgggccgagatcatgccactgcactcgagcctgggtgacagagccagaccccacctcaaaaataaataaataaattaattaagtaattaaaataattacaaatgttcatagacttgtaccaagaattttctcttctgggaatttatccacaatgacacatttaaggatatgaacaatttttaatgagaaggatgtgtctcacaatgatgtaaaatgttggaaacagcataaacggtggccaatatgggaatgtttgaaaatgtaaacttcttttataaatggagtattttgtaatttaaagtggcctcgtagaaatttgtttactgacatagaaaatgtgctttctggaacccaaagcaggttacaatgcagtatctatggagaaactattccatttcataaaataaaaaatttaaaaaactatgaaatatgtatgaatagggcctttctaccaaagtctaagtaaaaatttccagcactttcccatgggtgcctgaggacttaggtgtagttttcttacatttgcttttctgttttgagtactgaacatgacaccttttgtaataaataatgactaaaaatgagtggccaaatattaaacttcaagtctatacattacagcatatttatattaattaggagctagagaccacactaaataaattaatatatgttcatcagcggattactacgcagcccataaaatatttaaggacggtgtcacccttaaccttaggcaatccctaactgtgccttgggggaaaaggcacagttctaaatccccctctggtgtgtgggacctgaggtgtgtgggacctgggggaagcagcagtgctgaacatccggaggcaagacggtgtgggccccttcccttttctcgccttcaggcctctgtataaccctaaaacccaccagaccccacatggggtcatctagatgcctggaggagttccagggtggtcccttcgggcgtcatgcctggtttcattgtcctgaccgggtgcgaggagggacacctggccaggagatataacctgccggccagtgtggcatttctttcaaatgaccacttaagcctcagccacgatttggggtgactcaaatcgttcatgtggaacacacacacacacacacatatacacacacacgtgtcttagggacggacacacacaaacacgtgtcttaggggccccgtgtgaggagaggagattcacactactgacccagcaaccagggtcgaccccagagggctggagcacacactccgggttgacgataggcgcctggctctgggttgcacggctccggattggacggctcccgggaagagagaggagtcatctgacgtccagctcgccaatcagagtcgaggactggctgggctccacccaccttcttgctctaccagttcgcgctctcctccggcagaagtagcagctgcgctcttgctctctgggggagaacctggcgttatggccactcagtcagacatggagaaggagcagaagcaccagcaggacgaggggcagggagggctgaacaacgaaaccgcccttgcctccggggatgcctgcgggaccgggaatcaagatcctgctgcttccgtcaccacagtctccagccaagcatctccctcgggcggcgccgccctaagcagcagcacagccggttcttccgctgcagccgccacctccgccgccattttcatcaccgatgaggcctcggggctgccaatcatagctgctgtgctgacggagaggcattctgaccgccaggactgccgcagtcctcacgaagtttttgggtgtgtggtgcccgaggggggcagccaggccgctgtggggccccagaaggccactggccacgccgacgagcacctggcccagaccaagagccccgggaacagccgtcgtaggaagcagccctgccgcaaccaggctgccccggctcagaagcctccagggcggcgtctgtttcctgagcctttgccgccatcttctccagggttccggcccagcagctatccctgttccggggcttctacgtcgagtcaggcaacccagccaggccctgcactcctaagccacgcatctgaggcaaggcctgctacccgaagccgcatcaccctggtagcttctgctctccgcagacgtgcatctggtccaggccctgtcatccgaggctgcaccgcccagccaggccctgcttttccacaccgcgccactcatctagaccctgctcgtctaagccctgaatctgcgccaggccctgcccgccgaggccgtgcatctgtgccaggccctgcccgccgaggctgcgattctgcgccaggccctgcccgccgaggccgcgattctgcgccagtctctgccccccgaggccgcgattctgcgccaggctctgcccgccgaggccgcgattctgcgccaggccctgcccttcgcgtccgcacagcaaggtcagacgccggtcatcgcagcaccagcacgacgccaggcactggcctccggagccgttccacccagcaaagatcagcccttctcagccgccgctctctgtctgggtcagctgatgagaatccttcctgtgggactggctcagaaaggcttgcctttcagagcagatcaggctctcctgatcctgaggtcccaagccgtgcttccccgcctgtttggcatgcagtccgtatgcgtgcctcctcaccctcaccccctgggaggttcttccttcccatccctcagcagtgggatgagagctcctcctcctcctatgcttccaactcctcctccccgagtaggtctcctggcctaagcccctcatccccttcccctgagtttttgggcctgagatctatctccactcctagccctgaaagccttaggtatgctttgatgcctgagttttatgctctgagccctgtccctccagaagagcaggcagaaatagagagcacagctcaccccgcaacaccgcctgagccgtgaccctctataagcatcctctaagacccacagaaggaatcaacatttacccactttgtgaatgggctgcctgccctgtagttagctgcgaggtctcccaaagttccagccgttaaccaacatcctgagtagtttagaagcctctcctccccatgactccaccacctagcacttaacctgctgttggcctttgattctgggccaccttcttcctcaagagtttgcctttgcccttgagctgagatttctgttttccaagttgcttttctgttatgaaatgttttaattagtaaaataaattgttttgtttaaacaaaatgtagaggtgtgtttttttattgcggttcgaaaaatcgttaatcctatatcatatttggagggttaaagaaagttgttaacatactagctgactctttggacgagagaagaaataaaatactgtcctagcaataatttattcccactggctgaaatggagttctgtgcaggaagttcccacttaggtctatataccctcttagcagaggtgatttgcaacttgggcaagaaaaggggccagggtctaacccaggtggctggagaaaaggaggggtgatggagacatccagggtcaggaaaggagcagggaatgatgaagtttgggatgagaggtagggagacgataacccagatgggagtagggaagctgggaggaagatccagagtcaggaaatggggaacagcaggagtcagaagcttgagaggggaatatcttagattctaaaggataaaaaaatgtttatgtgtggggaacgggctcctgaggtctttgggggtggggagaatgtgggagggtgatttggggctaataattgatgggaaaatggtcagacattcagtggaaatacgtgttaatcgataatgttactgtaacaaaaataattgtaactgagtttgagcagatatgtgagggtgtgtgtgtgtgtgtagacatttggagagaactacatgggcatacaccatgctgtgaacaaggtgtatatcttttttttaataactggtgatatggtcttctataatctacaagttccacattgaccatataactatttttttaaattaaactccgctgttttttgaaaatttaagttgtagaaacataataggagagactacattaaaagaacagagtgaaaaaatataaagcaaaccagcaaaagaaactccctttccctcctttctcatatttctcctctcctttgctattctggtatgtgaacagtacaagcatagtcctgaccaaaaagggccctggtcacaatttggagggtcctgttcaggccctgctcatgctttattcacaccacaaagctaagagtccatgggggataagtgggacctgtgtgcccaccaggtcccaacatcctgccacttttatagaaagtgtttcaggtaccctcattcttcaaggctgtttctagggcttgcaaggccgtattctcagggtccttcctaaggaaagaacacatattttaaaagctctcactttgttatatttctttttcttgagtaattctagatatccaaagactaagacaaaaagtagacagttccaatgcagcaagtcacaacctcccagtattggagggcctacatttattcccatttcacagatgtggaaattgaggctcagagcaattttgtgattttcaaaatctcatagctaatagagcttggctccagagtcagaattcctgggtttgaattctggtgttcctattgaatcactgtgtgacccagtgcaagttagttaacctgggatccaaagcttctgcatttgtcaattgggcacagtaagagtgtacgtctccaagattattgtaaggattaaaatggatggtgcatattaagtgcttccaacagtgtcttgcacatcgtgagtgcccagtacagatggttcttactctgattaggattatgatcatgtgtccagatatttctgacagccccttaacaggttactggtctttcctaaacaacaatactttcaaaatcaaactggctgtttcaaaaatggagagggacattctttattgtacttagtactttaaaatatgaaggcatttccacaagctattgagcaacatttttaccaataccagaggccactgcgcaaaaatgtaaaaaaaaacaaaggattgagcctcagaggtacaaactctaggaatttaacaaatttatactcgcagtcgttacatgaatgcttctgagaacagtagtttttctcccagcgttatttgtatcttaacttgtttaaaatattcattttaatgaatgaatggaatacatcaaggattaacattattgactgcaagttgcctttatataatacctggcatgcagatataacaggtaaaaatcatagtatgcttgtatgtgttaagtactgttttaacgtttatacatacactaactcgtttaattcacagaacaaccttaggaagtagatgttcatattgagcccattttatagatgaagacgttgaggaacagaggttacataaaatatgaaggaaagacacattgaactgtggactctgtcatggcccccttgcgaggttattaacttcttttgtgaagtaaattgcatgatatgcccctgcacagagtactactgttttgccaagtgtgaaggtaatggtttgggcatgttcatctgcaatttattatgagaaatggtgttggttttgtattgtgtaaagttactctatcaacctaaacttcatatggaaggtgaacaattctagcccaaccacattaactcatttcactcgtgaaaatattcatagctggagattataattgattgtgtaggaaagacttatctacctagaagcagaagcaggtttagaaagtaacagcaacattacaggcctttcctgggaatttgtgtgccctgtgtgtagcttccctttgtgtctccatgtctaagtggtgtccaatccccagaaacagctgtgaactgggaaagaggtgggggtgaaaggcccatttcagagccctgcactcctcacagctgagcacagctttcaccccagggttcctctgtggggaacatgaaaacacccgaaaatccttcagctgcctttccctggaagttgccacaatcagctactatactgaacagtgctggttttatgggcacgtgacctgtgcagttgcacaggcccctgcttgctttaatgatgtgttgttgccatcttaaatgcttaatgatttttgaaccagttgtccctcattttcatttttcactgtacttcacaaattatatggctgatcctaaaactgtttttagtacttaaaaaaaaaatttctagcaagcagagtgccaggaagtgtagctggtggctggtaataaaaacagatgacattgccataagagtgagcttagggtaatgcaaactgcatgagacactggggttggacaagcctaggcttgaaatttgccccacctctgccttgctgtgtgaccttaagtaaggttcatagtctctccgatcctcagtttccacacctgcaaattggggataatagtatctactttatactcacaacttccgagaggagcctaggataatcctgtctacccacccttctggctgtggtttagggtccttcctccgtgttcccagagcctcttgttcttacccttgccaaagccctcattacacaattttggaaattatatttctgtataaccatcttcccactagactatgagaactttgaggacttggacagagcctggattttccgtctgtccccagaacctaggggccctaggccttggtaggcagaaagaagtatttcttggcttaatggtaatagtataagctacatgcttaataaagaataacaactaatatacaaaatatgtgttggaaataatatgtaagaagtgtgtaaacccaagatatttccctacttaaattttcttcactcagagagggcgtggccttttacccttttttcagaaccatcaagagccagtgttttcccaatatcttacttcatagtgtaactggcaacttctgttactccctcagtctcagatttggcctcacagtggacctgcactggacatggcactgaaggcttcccaaacacagtgttattgatgctaaataggccgtcaagaaatatttgttgaataaatgccttgttagattaatagaagccagctaattacattattttattttataggtaaaaggattctatatcatttggtcttatactggcaaaatcgaggacatgagctaagaagtcagtggaattgtcaagttcaaggagcatgttcacacacacacaaagagcccactctcccggtgttctgttttttctatgaccactcatttccagtcaatttcactttcttctcctctcctgtgttccattttcacatcaatacactatattgcaaatgccatcaaattcatcagatacagacttttattgagcttctcaggttgtgtgactgccttcccaaacagaatgtgagcttcttgagggcagggaacatgctatcttggtcattacaaaaaacagaatctaaaataatgcctaaaatatggtaggagtcactgaatagttgttgaattaattaatctgttgtgacacatatgaaaaaatatctgcctttcaatttgaggatcgttgtataggcaccattattctatagacactacctgtataggcaatatgtgtgtggctttttttatcagttaccagatgcattctgatattcagctgtaaggaattgagagaggattattccaattcctctttctacagcatttttgtatagtaagtagtacagttttcagtacacaccttaaataaggatagtgttccccaaaccacaggcattcataagaaacctttaggatttcttaaaattttctttctttgtgtctttccctttctttcctttttacttgctttctcattatctttgcctcttctctctctccctccatctttccctcttctctttctccctccatctttccctccctctcttcccgcttccccttcttctttccttccttccattgtatggatagtccacaatttttatttatccaaacacattaatggatatttgatttgttttcatgtttgggctattacaaataaagcttccatgaacattcatgtacagatacttgtatagacaagttttctttcctcttgagtaaatacctaatagtgaaatagctgggtcatggtaagtatttgtttaactttttaagaaacggccaagttgtttttcaaactgtatgtagagttttatattcccactggcagtgtatgagtccaattcctccacagccttgccaacaattgatgggggcagacattaaaattttagacactctaccatcaatgatagactagattaagaaaatgtggcacatatacaccatggaatactatgcagccataaaaaaggatgagttcatgtcctttgtagggacacagatgaagctggaaaccatcattctcagcaaactatcacaaggacagaaaaccaaacaccgcatgttctcactcataggtgggaattgaacaatgagaacacttggacacagggtggggaacatcacacactggggcctgttgtgggatggggggatgggggagggatagcattaggagaaatacctaatgtgaatgacgagttatgggtgcagcaaaccaacatggcacatgtatacatacgtaacaaacctgcatgttgagcacatgtaccctagaacttaaagtataattttaaaaaaaattttttagacattctaataggtgtgtagcagtatctcatggtggttttgttgttgtggtggtggtgtgggtgtgtgtgtgtgtgtgtgtgtgtgtgtgtgtttgagatggagtctcactctgttgaccaagctgcagtggcatgatctcagctcactgcaacctccgcctcctggattcaagcaattctcctgcctcagccacccaagtagctcggattacaggcgcccaccaccatgcctagctaatttttgttttttttagtagagagagggtttcgccatgttggccaggctggtctcaaactcctgacctcaagtgatccgccaccttggcctcccaaagtgctgggattacaggggtgagccaccacacctggcctctcatgttttttatatgaattttcccaatggctaatgatgttgaatatcttttcacatgctactttgtaaatactctggcaattatttattgggttgttcgttttcttactttgagttctgagagttctttatatattctggatacaagtcttctgttagatatgtgacttgcaaatatcttttctcactctattgcttatcttcttatttttatagtgccttttgaagaacagaaatttttaattttaatgaagtcctgttttataaatcaggcttttggtgtcgtatctaagaaatatttttctaattcaaggtcacaaagcttttgttctacatttttctcaaatttttatatatttagctctcatatttagttttatgatctaggttgagttaatttttagatatcactcaaggtatagatcaacattcatattttatttttggatgtggataaccactggttccaggaccatttattgaaaagattaactttttcccactgaattgtctttgtacttttgttgaaaatcaattgaccatatatgtgctgacatttctggactctattatattacattgaatttcaaagagtcagtagcacactattttgataactgttactttacaataagtcaaaaaaacagtttcttccttttcaaggttgttctggcaatttcagctcttttataattcaataaaaattttagagccagcttatccatttctactaaaaaatcttgagatttattaagtataatttgagatataatatgccacatatatttaaagtacacaaatttgatatgttttgatatatgtatatatatgaaaaccatgaaccatcaccacaatcaagataatcaatatattcatcaaactccaaaagttttctcctgcttaactgtaatcccttcctcttttcctatacccttaccctgttcgtaggcaatcaattatcagcagtctgtcactacagattaatttgcattttctaaagttttatataaatggaatcatacagtatgtatacttttatgctctggcttctttcactcaggatacttactttgagatacatccatgttgttgcatatgtcaatacattataccgttttaatcaatgagtggcattatatgtatataccaagatttatttaatcatttacctgttgaaggacatttgggttctgtttaatttttgactattacaaactactatgaatatttctgtatgtatttgtaaggacatatgcttttccttttcatgagtgaatacctaggtgatgaatgacctaggagataaacataataggaatatgtttaattttctaagaaacctccaaatatttttcaaagtggtggtatcattttacactcccaccaccactatgtgagggttcctgttcccttacatccttgtcaagccttaatatcgtttgtgtttataaattttcacattctaactgtgtaatggtagcacattggggttttagtttgcatttccttaataacaaatgaggtttgtcttttttatgtgcttgtcagtaacatattttcatttgtgaagtgtgcaaacaaacgtgaacctaaaacagccagtccttcaagatggattttgagtggctaacaggacctaaatttaaaatacagccaagcggccatttgctgactagagatcacacaggtactcttgagtttcctggaaaactcacgcctttgtttacctttggggctttcagagctcacctgaactaaccaatcagagcccacctgccttagccaatgagcgctcagttgtatcaaccagtcagagctcagctgtgttcaccaatcaaaaccaagcaagtctgaatccttcatttgtataaaaggtcctgactgggaacctgagtaggaactttctctatgaaagccaaaccatctctttgttctctggaatacactttcgttttacacagaaggctgtgtctgtttgcaaactgttaagtctttcctccacattccttttcagagaacttttgtttacattcttagtgtcagaaacaggatttgaagccatccccaactactcccagtgccatctgagacaaggtataagtgcctgcaagagcctcctgaggtcagttgtcttcttactggtgccagggcttcagggataggctagggtaatttctctcaaattcggacctcctaccccttgtttaaggtctcagagactttattcctttcctgtaggttccctccatccagaccccagaggagaccttccttttgtctcctggctgggatggggcatgggaggcttgggagagtggccttcccagccagttccccctatctggactctggagggggcattccctgttggccccaggcttagtggggggccttccaagtctcagccagttccctccatgtggatcccagaggtggtcctcccagtcaccccaggtttagagtgttgtgggactcgggaggacaagagagacctcgggttgaaacagcagaatctttattgagtgcactcaggcccagctgactcacatccaaaagactgggcccagaacaaagacagtacctgacttttatacacactttacaaaagggggtgggctagctggaagcaagctcacagtggcatgaaagcagggatacagaggcagaacaaaggcaggattgcacatgaccattgccaagcaacccagatgttcgttatctaggtttgcctgggcatgggcttatcccataaccttcactatggtgcccaagcagctgtagttcaggcctgctcaggcttctcatgatcttcattgtacctcttagataaaacagagtacttgaagtcactagttacagagaacaagaatctataaactcatttcataaaacaaaggaaaatttgtttttcttctccttacgttgagggagtgctgggagagtctccagagcacattagataatactatcaagacttttcctgggtctgggctgtgcctgttgctgcctctgggacaagtcgcctaatacaggacaacttatttctctttctttttaattttctttttctttaatttcccgcctcaatagggggtccttcccagcccaactcagctggtctataaggttttctggggatgctcatgctacaggcaatgacagggaggcattcgtcatgtcagtgcaatgggtaacccatattttaagtttttccttgatcagctgccttctggcactccagcttgatttacgagcaaaaattatggtccagggaactgtaattggctaggtctctggacaaaaattatgcaggacaatctttaactttattggccaaatggggcttctttgaaattccaaaacctgactatgtgcaggcacaattagaagaaagaaaacatggaacattccagagacaatgggaaacctttttttcaactggtactttgaaagttctaaatggaatcaaggggctaccattgcctcttagggaaaataattcccaattgagtgagtgccttaatgaaacagagagaagtgcttgtcagattgaaactaaagctggaaaaaagaagcccgctctggaagaaccttcttccactagcttccccttgcctgccactcggcctgtcttctgcaccttttttcccacctctgctttatctttcactccctccttcctcttctactctttgattttgaagggattacattttctctagactcatctgtatgttttcttgtaaaattctgtgataaattcccatgattttatgttaccttggtatccatttcagtcttcctctaaaacacccaaactacttgaaaaagcctaaattttctgtgctttgaaatgtaaatttgttgccctgttctctaaaattcggtaaaggcatcagccatgtgggacagacaaatgtcagtttattccatttacagagaaatagtttgaatctaactgttctttaaactatgagttttacctgactcatagctacaggcttaggattaaagctacaagatcttttttgtctgtctgtattttctttgtgtgtgtgtgtatatgtatatatctgtatattgtctacagaaccaaattggcttataaataaatgaatactcgtaaattaagcaaataaacgcaaatgcttttcaagttcatgtgacagccatcttttggtggatgggactggtctaatattgttggtttggtggcaatggctatgtcttctgagtcattagaaaaatacgtatatatttaaatttagggttcttttatacttatctggcatacagtaatgtaaaattgttgacagaaaattttgtttacgctagtggctagatttttctagtgtctcatgaagtcttctagatgtaattgttaagagtgaatgaattgaatggatgtaaatgggataaaagtttgtaaatgaacttttgaaaatggttatgtttcataatatgtttacttgggaggacgttcattcaattgaattagatcatttccagataagatgtaattctgagacattggttactgaatacgagttcaggctcatatgcttttggcttcttatttgaaagaaacaaaagtcatttgagtctgttggtaaatatgtcctgttccatattaaaaggatattctgttagcctatgtttctggaaattgtaaaatgtgtattcatggattgttggtacatgattggcagttaaaaattgcttaagtcccaggttttcactgaagattagggttactaagagttaacattttaattaatgtgtgtgattaaacagacgagaaatacagtctgtatgcaagtatatgaggagagtaggatgtatattttggtaagatagattgaagagaaaagagaataattttgtataagaaataatctcttgtggtaaatttttgtcctaaagtgactgattatttaagaaagaggaagtataggagaaagcagaaaatctaaacatgttataaattgtctaagcacattataataggcttatgaaaagaaagtttataaaaggaattttctgtgtgatcaggttggctatgattgaaaggaaaatttttattggtctttctaaggattgagctttgatgtttagaaatgcactgatgcagaattttaaaatctaatcccctgtgttagaacaagattttcttaaaatattgatttgctcttagtaaagttgcaggatgtttttatttttaattccaaaatctcttcccttaacagccatccttcaaattataaacagtttttatttatgccacatttctttcttagatctacctaattttcctagtttcaggttagaaatgcagctgtcctttttacccttgaaaagctatatcgttttgcttggctggggtaataatcctctccttcaaccttttcatcacctcctgtaattttttctccagttctaacacggatgttatggcctgatgctaaaatgtttatcttgaaagtctagaaagacaatgtttccttcagtacaacttgattctgtacttttgacttctgttgatgtttctgaattgttccatgtaatcaggaaatttcccatgctgttactaaaaaccatgtattcccctctgctcaaggtactagttttcttgtttccatccctctttaatatagtgtacacccataatcctggacacacttttcctgtgtctgattaaattcaggtaccctcatttaggtccgtgggcacaggcctgagggtggagccctcaccagggactccgcccttctctatccagcagttccttgccctactcccgcatcaccatcactgctttttccagcattgtttcagtgaagttctgggagaaaagtttttaagttgtctgtattgcttatatgaatatatgtgagaaaagtttttaagttgtctgtattgcttatatgaatatatgtgctgctctccttttgaatgttgcttctgtactagtcataattatactaaccacatgggttgctgtcaacattcaatatttgcgttattttgctgcttagttttacatctttcaggccacatttcaaactcagctcgtttgttgtccctccagcagtacttgagactgccacctagtggacgtttatttgctgatcgagttttctgtttacaaaattttctccattttcaggagcacattaacagtaccccattcctccaggctttatgcattttcagactccttcagattgtccttcaatagactttctttgctgaacaaaagatgctcagtcatgtggacgcccagttgcggggatttcaccggtgaattccaggtattataactggcaaaccagtgaggtacagaaaggcttgttggggagacattccagctccccagctggcagcaggggccatcttggtcgtgcctggagatgtccagtgtcggtgagacttaggatggtgcatggcaaatgctcattacctcctagggcttcagttttatggggattcaaggggactccctggaccccaccatggtccagctttgctcttagggacacccatggcctcctggatttcaatatatgtttcaagcagaaccccttattcccttaggtttagtcctatcctctctgttgggattagcagggtcagctatgggagttggagccttgggaagccagcataaactgtctcaggagactgcagcggccctccaacaaacagcaaaggacctaactaggcttcaacaacagctagactccctggtgctatagtcctacagaatcaaagagccttagatctcctcacagctaaataaggaagaatatttttgtatctaagagaaaaatgccatttttatatcaacctgtctggtctggtccaagaaaatattaaaaatattattttccaggcagacaaaattgaatctttaggaacttctgtggaaacttagaagcaatggctattatctgccctgcttcccttaatataagtggcaattattaccatacttttagccttaacttttgggctaactttgtttaaaattctaactgatttcttgctctctagcttacagcaattccaggaccacatgatggttttgcaaagcttccaacctttagctgctaatgagctatctcatttcttgtccactggtcccatgaatgacatggcttacactccattagatcaggcaagaagagactttagggcccagctaggcagggacaatgttgcactgagcaggaagcagtttcagaaaaaattacctagcccctcaacctcccatatgattatgggccctaaaatctcttaggtggggaattgaggcaggataggtggtcaaggaagtgaccatgtcctcgggatgcagcaaccatggcgaccatacagtcaacacaataagccccagcattcgcattgtagttaagttcattcaagcaaagctatctccagtagggactttcccgtctagagaggatgtgcattttgattttgcctgtcctcaaactgaccctttgttcattataatagtaaataaatacacccctgggtggagatttaagatgctaatgagacatgtgacctatgaacaagcatgtacagctactgtgcatatacattcagaggaccacccagaacatgcttactagtaacatgtcttcccacttccttatgaataatcatgtaagactcccagaaagggagtttccccagtagtaatcagcactgtctcatccttatgagcagcccaccctgaattctctctgtctcagggtgtactctctattctgcacttaactttcaaaatattatttttcctttgcaataaatttctctatcttgtgtctcctcttctgtgtgtctcttgtttaaattattttaaactaagaagacaagaaccaaggtctcacaacagccatcaacagtaccaaatccataaaccccaaggatttttttctgacaactgtgattttagcttctctctggactacagctaatttgtagtataactatgggctatatattttgaagatatggcataatgctatttcccattaatggaagcttccaagtcaagggaaacttcaaatctggtcacacagattacagtaatttcactattgcaattctatttataatcaacataattgtatttactatagtagtaaaggtagagttgtttttatgacttaattttcctttttatattttctgtccaagatcatgagtcatttgaaactgtattagagcctcaattcaccatgtaaagtaatgcaaatggtgtattctttccagctgtagttcacatgtcagcaaaggacacaaatggaaagtatcttaactccttccttcaacacttgctgcaccaggtgttacaggaacagtgataaaacagacaaaaagctcacaggaatagagagagaaaaagacaggtacacaatgacaacacagtttgatcaatgttatacagagatagatactgggatgaagaatcacagaaagtgggtattttcccttgtctggtggatcagtaaagacagcctaaaggaagatatatgtccctaaattttgtaatatgagaaaggcttaactagagatgcagcagaagatatttctaacaaagagaatagccgttgctggaaaattcagagtggtttgtttaaattagtgattcccaatcagggaaaattttgccctcccccttcagggacatttggtaacagctggaaatatttttgattgtcacaactgggattttcctactagtatctagtaggtagaggagccaggggtgctgctaaatcccacaataaagaattatctggcccaaaacgtctatagtacccaaattgagaaatcctggtttaaatagatcatgaatcagtgacagaaatgtttccattactacccacacaagattgagtgatatggagtcattctgcagatactggattcaatataataatatgattttccataataaataggaattactcatttattgaggccttaattgtgtcaaaataaaaaactgtacttgacagaatattatatactcaatattatatgctctgcagggacatatcatgcagttttactttgaaaagtagttcatcaaacactttgccaggtaagatatagagacaacagatgaccacaagaaaagatgattcaacatctttaagtcattagggaaattctaattaaaatcacaatgagatagcgctacacacccactaggatgactaaaattaacaagtggccatactaagtgtgacaaggatatgggataattggaactctcatatactgctagtgggaatgtagaattatacaaccactttggaaaataatttggtcattttgtaaaaattatttacataggtgattatccagaaatataaaagcatctgcccatgcaaagatttgttcatgattattctaatagcagctttatttgaaatagccaaaagttaaaagcaatccaaatgtttatcaatggcaaatggataaacaaactcgtatattcttaaaatgaaatactactcagtaattaaatgtattgaactactgatacatgcaaaaacataaaagaatctcaaaatgattctgctgagtgaaagaaacaagacagagtacatactatatgattctatttacataaaattttagaaaatgcaaactatagtgtcataaagcatattaattgttacctgcaaatgaaggggcagggaaggtgggaggaaaagactataaaagggcatgaagaacatattgggtatgatggatatgtttattatcttgatgatggtgatggcttcatatatcaaaattcatcaaattgtatactcaaaatgtgtatcatttattatatgtaaattgcaactcaacagaattgttaaaaatgtggttcataatattaccaagcagtttgaacagcttataagttaacatttttctctaatcactattaacttctttttcaatggatacataaagatgtacaattttagggtacatgtgatattttgatacattcatattatgtataaagattaaatcagggtaattgagatatccatcaccttaaatattcaccttttctttatgctaggattgttcaaattattttcttctagcaattttgaaatgtatactagattattgactatagtcaccctactgatctgtcgaacactaggctttatttcttctgtcaatcactgtatatttgtacccattaatcatctctctttatcccccattcctttctacccttcctggccactggtaaccaccaatttgctctccatcttcgtgaaatccaccttttaacttccacatatgaataagaacatataatactagtccttctatgcttatttcacttaacataatgacctccagttccacccatggtgctgcaaatgataagatttcattctgtctatggctgaataatattccattttgtatatataccacattttctttaaccattcatccactgatgggcacttaggttgattctgtattttggctattgtgaatagtgctgcaataaacatgggagtgcagatacctctttgacatactaatttcatttcctttggagatataaccagtagtggaattgttggatcatatgatagctctattttacgttttctgaggaacctccatactgttttccatagtggctatactaatttacatccccatcaacagtctatgagggttcctctttctccacatcctcaccagcatccattattgcctgtctttcagaaaaagggcattttaactgaggtgagatgatatctcattgtggttatgatttgcatttcactgaggattagtgatgttgagcaatttttcatatacctgttggccatttgtatgtcttcttttaagaaatgtctatccagatcttttgcccattttgaaatcaaattatttgatttttggttttggtatcagggtaatgctgaccttatagaatgagtttaagagtactcccttctcttcggttttttcaaagagtttgagtagaattggtattagttcttctttaaatgtctggtagaattcaccagtgaaggcatcaagtcttgggcttttctttgatgggagatatttacttcttacttaacatctctactcttcagttttctcataagtaaactgctttcttgttttagctattctcaaatctaagtataaatttaattaattggccactaagaaatgaagtactgatgacctcttagaactattcacatagtgattatgtagaattatattaaattacacgaatttatgccctatagaccgcatcctttatatgcactgtcttattttacaataacaccagtaaaaatatattccttaaatttaaacaattttattcttaacatcctatcatctgggactttagcaaggggtcaccttgccactccgggctgtttgttttctgtctttttggtcatcctcatttcttttcccagaagtgatatctgagagtcaaaaatgtttgaaacaacctaaaccattttctcttttttttccttattacctgctctgaacataagccttattgcaaaaactactaatgaacaatttttttattctaccttcctcttattgattatttctctcttgctaccacactgggtggctctagccaaggaggtttactatacttttttttcttctataaaaaggatttttgaatcccaaatggaatttgagcagaggtccaaaaatgaatctggtggctcttcgtataatccaatttataacaatttagttaaattttgcctaaacttgtaagccaaggaaccaatggtcttggaatattatattgaaaatttatggttccaccatataccaaaataggaaatacagaacacttataaaaacatatctagtcatatatataaactggccccaggcactcacacaaactcacatacacattccagagacagaatgtcttctaattttatcaatggacatgaatgtttataattttgtagctcaattattatcttttgggaggattcatcacaaacaattactgtccgtgacttttccttgatttcaattcaattaacttccaactgatttacacacattacagaatttcaaaggcagatttcttcatttagaaaacaaatccccacttgatcaacgagaaatattattaacatattttatacagaagtactaacatttagaaagacaaaatcataggctagttattttaccatttttatatctcttgatcactttagttaaatataatatatagtcttaaccctaaatatgactgaagatcctcaagccattttggtccttcttgctaatcaaagtttggttcatgaaccagcagcataggtatcatttaggaacttcttaaaaatgtaaaacctcaggccctaccatattcttacttgaattaaaatctatattttaacaaagacttccatgagatgtatatgtacataaaagtttgagaagtacctatggtaatatctttagtcaagtctatttcttgttttcatccaggagcccatcttatctttaaatgtgattttcatacatctgctctgattttgtagttattcctttgattacaatattatttttcttatatccaagttctcctagttgcctcactttttccaccatgtgtgtctgaatggaaatggcttatttcctgctgattttttttattattattatactttaagttttcgggtacatgtgcacaatatgcaggttagttacatatgtatacatgtgccatgctggtgtgttgcacccattaactcgtcatttagcattaggtatatctcctaaagctatccctcccccatccccccaccccacaacagtccccagagtgtgatgttgcccttcctgtgtccatgtgttctcattgttcaattcccacctatgagtgagaatataggtgtttggttttttgttcttgcaaaagtttactgagaatgatgatttccaatttcatccatgtccctacaaaggacatgaactcatcattttttatggctgcatagtattccatggtgtatatgtgccacattttcttaatccagtctatcattgttggacatttgggttggttccaggtctttgctattgtgaatagtgccgcaataaacatacgtgtgcatgtgtctttatagcagcatgatttatagtcctttgggtatatacccagcaatgggatggctgggtcaaatggtatttctagttctagatccctgaggaatcgccacactgacttccacaaaggttgaactagtttacagtcgcaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatatgttttttggctgcataaatgtcttcttttgagaagtgtctgttcatgtcctttgcccactttttgatggggttgtttgtttttttcttgtaaatttgtttgagttcattgtagattctggatattagccgtttgtcagatgagtaggctgtgaaaattttctcccattttgtaggttgcctgttcactctgatggtagtttcttttgctgcgaagaagctctttagtttaattagatcccatttgtcaattttggcttttgttgccattgcttttggtgttttagacatgaagtccttgtgcatgcctatgtcctgaatggtaatgcctaggttttcttctagggttcttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttctttctgagggctctgttctgttccattgatctatatctctgttttggtaccagtaccatgctgttttgcttactgtagccttgtagtatagtttgaagtcaggtagcgtgatgcctctagctttgttcttttggcttaggattgacttggcgatgcgggctcttttttggttccatatgaactttaaagtagttttttccaattctgtgaagaaagtcattggtagcttgatggggatggcattgaatctataaattaccttgggcagtatggccattttcatgatattgattcttcctacccatgagcatggaatgttcttccatttgtttgtatcctcttttatttcattgagcagtgatttgtagttctccttgaagaagtccttcacatcccttgtaagttggattcctaggtattttattccctttgaagcaattgtgaatgggagttccctcatgatttggctctctgtttgtctgttattggtgtataagaatgcttgtgatttttgtatattgattttgtatcctgagactttgctgaagttgcttatcagcttaaggagattttgggctgagacgatggggttttctagatatacaatcatgtcatctgcaaaaaggcacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagagttgttgaattttgtcaaaggccttttctgcatctattgagataatcatgtggtttttgtctttggttctgtttatatgctggattacatttattgttttgtgtatattgaaccagccttgcatcccagggatgaagcccacttgatcatggtggataagctttttgatgtgctgctggattcagtttgccagtattatattgaggatttttgcatcaatgttcattgaggctattggtctaaaattctcttttttggtggtgtctctgcccggctttggtatcaggatgatgctggcctcataaaatgagttagggaggattccctctttttctattgattggaatagtttcagaaggaatggtaccagttcctccttgtacctctggtacaattcggctgtgaatccatctggtcctggactctttttggttggtaagctattgattattgccacaatttaagagcctgttattggtctattcagaaattcaacttcttcctggtttagtcttgggagggtgtatgtgtcgaggaatttatccatttcttctagattttctagtttatttgcatagaggtgtttgtagtattctctgatggtagtgtgtatttctgtgggatcagtggtgatatcccctttatcattttttattgcatctatttgattcttccctcttttcttctttattagtcttgctagcagtctatcaattttgttgatcctttcaaaaaaccagctccagtattcattaattttttgaagggttttttgtgtctccatttccttcagttctgctctgattttagttatttcttgccttctgctagcttttgaatgtgtttgctcttgcttttctagttcttttaattgtgatgttagggtgtcaattttggatctttcctgctttctcttgtgggcatttactgctataaatttccctctacacactgctttgaatgtgtcccagagattctggtatgttgtgtctttgttctctttggtttcaaagaacatctttatttctgccttcatttcgttatgtgcccagtagtcattcaggagcaggttgttcagtttccacatagttgagcgattttgagtgagtttcttaatcctgagttctagtttgattgcactgtggtctgagagacagtttgttataatttctgatcttttacatttgctgaggagagctttacttccaactatgtggtcaattttggaataggtgtggtgtggtgctgaaaaaaatgtatattctgttgatttgggggagagttctgtagatgtctattaggtccacttggtgcacagctgagttcaagtcctgggtattgttgactttctgtctcgttgatctgtctaatgttgacagtggggtgttaaagtctcctattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgctggttgaaagtctgttttatcagagactaggattgcaacccctgcctttttttgttttccatttgcttggtagatcttcctccatccttttattttgagcctctgtgtgtctctgcacgtgagatgggtttcctgaatataacacactgatgggtcttgactctttatccaatttgccagtctgtcttttaattggagcatttagtccatttacatttaaagttaatattgttatgtgtgaatttgatcctgtcattatgatgttagctggttattttgctcgttagttgatgcagtttcttcctagcctcgatggtctttacaatttggcatgattttgcagtggctggtaccagttgttcctttccatgtttagtgcttccttcaggagctcttgtaaggcaggcctggtggtgacaaaatctctcagcatttgcttgtctgtaaagtattttatttctccttcacttatgaagcttactttggctggatatgaaattctgggttgaaaattcttttctttaagaatgttgaatattggcccccactctcttctggcttgtagagtttctgccaagagatccgctgttagtctgatgggcttccctttgtgggtaacccgacctttctctctggcttaccttaatattttttccttcatttcaactttggtgaatctgacaattatgtgtcttggagttgctcttctcgaggagtatctttgtggcattctctgtatttcctgaatctgaatgttggcctgccttgctagattggggaagttctcctggataatatcctgcagagtgttttccaacttggttccattctccccatcactttcaggtacaccagtcagacatagatttggtcttttcacatagtcccatatttcttggaggctttgttcgtttctttttattcttttttctctaaacttcccttctcgcttcatttcattcatttcatcttccatcgctgataccctttcttccagttgatcgcatcagctcctgaggcttctgcattcttcacgtagttctcaagccttggctttcagctccatcagctcctttaagcacttctctgtattggttattctagttatacattcgtctaaatttttttcaaagttttcaacttctttgcctttggtttgaatgtcctcctatagctcggagtagtttgatcgtctgaagccttcttctctcaactcgtcaaagtcattctccgtctagctttcttccgatgctggtgaggaactgcgttcctttggaggagaagaggcgctctgctttttacagtttccagtttttctgctctgttttttccccatctttgtggttttatctactttggtctttgatgatagtgatgtacagatgggtttttggtgtggatgtcctttctgtttgttagttttccttctaacagacaggaccctcagctgcaggtctgttggagtttgctagaggtccactccagaccctggttgcctgggtaccagcttcagtggctgcagaacagcggattttcctgaaccgcgaatgctgctgtctgatcgttcctctggaagttttgtctcagaggagtacccggccgtgtgaggtgtcagtctgcccctactgggggtggctcccagttaggctgctcaggggtcaggggtcagggacacacttgaggaggcagtctgcgcattctcagatctccagctgcgtgctgggagaaccactgctctcttcaaagctgtcagacagggacatttaagtctgcagaggttactgctgtctttttgtttgtctgtgccctgcccccagaagtggagcctacagaggcaggcaggcctccttgagctctggtgggctccacccagttggagtttcctggccgccctgtttacctaagcaagcctgggcaatggcgggcgccccttccccagcctcgctgccgccttgcagtttgatctcagactgctgtgctagcaatcagcgagactctgtgggcgtaggaccctccgagccaggtgtgggatataatctcctggtgcgccgttttttaagcccgtcggaaaagcgcagtattggggtgggagtgacctgattttccaggtgccgtctgtcacccctttctttgactaggaaagggaactccctgaccccttgcgcttcctgagtgaggcaatgcctcgccctgcttcggctcgcacatggtgcgctgcacccactgacctgcgcccactgtctggcactccctagtgagatgaacccggtgcctcagatggaaatgcagaaatcacccatcctctgcgtcgctcacactgggagctgtagactggagctgttcctattcggccatcttggctccccccctcctgctgatttttctctcacttcaaaatgtgtaaaggccggaatattatatactttcaccagaagtcatggtatagtcacaactcaaatatttggggagattgaagtgatgggcatttggaggatacattgtagttgtactagagatgctgttgccatactgagtgttttgaaaatgaaagagttattgagacatgctgacctacaaaaacagattaatgtagattgagtactttccatgtgtcatgaacaattctaagacaattgcacacattaatccatgaatcttaaaatgtataatgctgagttgtcaatgtttcatagaggcatagagagctgaaaacaactatcctaacgctgcataactagtaagtggcagggacaatccaagttgcccaagaacagagatctatttttaaatactgtgcttttcctcttacaacagacagatttcctatatctagtttgttcagaagtatgaaatagcttaacaattaccaaggctattagttttctcccatttctcaccctgtgtcagggagaggctctgttaaggaatcttatggtcacaaaatctcattacaaattcagtcatgtcatataaaatcaatttttttaaacattttattttgaaatcattgtagatacacattcagttgtaagaataatccagagaaatccagtgtaccttttatccagtttcttcacaatggtatcaacgtgaagaactatggtataatatcacaaccagtatattgacattgatatactgcacttattttattacaggtttacttacattcttatgtgtgtgtgtgtgtgtgtgtgtgtttagttccatgaaattttatcacgtgtaggttcatgtacccaccacagtcaagatatagaacagttccatcagcacaaggatcctttgtgttgccctttatttattatttatttatttatttattgagatggagtctcgctctgtcaccaggctggagtgcagtggcacgatctcagctcactgcaagatgagccgagcggctcactgcacctccgcctcccaggttcaagtgattctcctgcctcagcctcccaagtagctgggaccacaggcgcgcaccaccacgcctggctaatgtttgtatttttagtagagacagggtttcactatgttggccaggatggtctcgatctcttgacctcatgattcacccacctcggcctcccaaggtgctgggattacaggtgtgagccaccgtgcccggcctgtgttgcccttttaaaacaatacccacttcctttcacaacacctttgtccttaaccctaggaatattatataaatggagtcatacctgtgatgaacatctgtctacaggcttttatgtgaacatgaaggtttcatttctttgggatgaatgcctaagtgttcaactgctgggttgtatgataattgcatatttagttttgtaagaaatttccaaactgttttcatgatcatttttgaatacaaattaatcaatcaagtgcagaagaaattgattagggaaatgcctgtaagaaaaaatataaaagaagctgggtaaggcaaaaacagattcttgcccatttaatcttgtcttagcttccacttatctgaggacttgaatgagtacatgagtcatgcttgcagacactgcctccactgagcctatagttcagctgggaagtcagcctgaatgacactgtacattactgaaactgaaggcagtttgagcagaaaggctttggagtcagatatatcctgtgctatatctttttggttttgtgatcagtgagataatctatgcttctaaaccggtttgaatcagatgaggaaaacaaaacctacctcaaagggttatcattagacattagtgttggtatactagtctctccataaatgtttactgctagtactatagtgcactactcagaatgtaggatgaaaaataatcaagtactgtccatgccatccagacagcgcatacaaaagaccagtgtatttagtgcaaattggatgttgacctgaggatgtgacagtctgacaacagggaaaacgtggtgtctgatagcctatgagagtattaactggtagctaattctgtgagaaataactgagttattaacaataatgacactaagaatcttgagagctaaattttatacagtgctcaatatgtgcccaatactcttgaaagcaatttatgtgcaatcccatacgtaatccttacaacaattttatgatgtacaattatcctcattatataggtgaagaatatgaggatcagagattaagtgacttgctcatgatcacagagatcctagcatgtagcttgactccagtgcctgactttgaaatgccaaattcaacaaacactctgtgagatattgacctcccttaacaattctgaccctcatattctccatctctgtaatgaggaagaaataagacatacctcaccaggaagttgtgaggcttaaataaggaaatatatgtaaagtactggcactgtgtagatattcaataaatgaaaaatattacaattatcagttgtgttacatgacactcccatcttgtgtcacatagacactcagcaaatccagagaaatcttagtgaaagctcaggtaggttccattggctgtaaaaccactgggacttcttagacaaggcttacagttcccaaaggaattttcccctcctccacatgctaaaggcaccaccatgctctcagtcagcctgagttcaggcacaccacaagccaaaacaaccacaagttaagtctttccgtttacaggtagatgggaatgaggtgtgtgggaagcttaccctagaacagcagacaggctacccagagagggaaggtatagaggccatactgagatttgtggggcattttaccacctctatgaaactctgccactactagggactttagttgttcaaggagctggggaacaagatccaaggagagtcctatccccatgataagaagggaatcttgctgcctcatctcttccgagttaccccttcacatggccatttcttattgatcttttagtgcccagcttagccattaattcctcttcataaatatctcaagtacaaccgtctcacagaagtcatattatatttacaaatcactgataaccacatggcaaagataatcttattggaagtctaagagttcaaaaaggctaggttatactcataaatctttcactttttacttctgtgaactttaggaggttccttttccttattctttttagttgaaaagaattgtattttagtagccttttctgataattgcaggtattctttttggatactgcatcgaaacttgagaagtggtagtttcttaaaagttagttacaatgtgtaatcaaaccatatcaatgaaatttttatacccttaaattcattaggctatcttgtactttgaatgtattctttacccatgcatgatcttgtaacctcatgattgattatttggaaaaggttagttcactgaattatacaaatctaacttaggaagatttctaaacctctctgagcttcattttctgcaaaataggaaaataatgacttgtaacaaattagataagcaataagtaattacaaatataaacaaaacctgcaaaggattagtagtcctatgaacagaattaagccagaataagcagataagtgagtgtccccagtgagaggagaggcagtgaaggtgagaaggagcagtgtgggtttcagggaacctgacatgatttagtatggctacagaaagaatgagatatggagtatggtgtcatggtgagaaataaggaaatataatccactggtctgaccacctggaatggatagagaggtaggagatgggagctagatagagaggtgaaggaagagttgggagatatatagagaggtgaaggaagggggtccatttagggagacttccaagttgctagcttgactagggaaaggaaaagattaatggagaagaaacaatgggtattgtctgatgagtcaatcaaaagaggaaagaggatcaaactaggagtcagcacacctgtcatcctttttattgtattttattttatttatttatttatttatttatttatttatttatttattttgctatcttctcctgaatgtgtgacttgaattacgagagagctgagatttccattatattgcaggaaaatgggacaaaaacacctcaggtgaggaacagaaatttgttgttcaaaccacagaactatgtatagtcatgaggatagctccatttaatgatctcccactctaataacagaacaaaaatatagtaaatacttactgagtgctttttctgtgataggcactatattgggtactttctgtgcttggcatcatttaatccctacaagaaggtgtccctctcattgaggttagcttttatgtttcaaaaggacttaaaaacctaagggc
